United States Patent
Zhang et al.

(10) Patent No.: US 10,808,234 B2
(45) Date of Patent: Oct. 20, 2020

(54) VARIANT AMYLASE ENZYME COMPOSITIONS AND METHODS

(71) Applicant: Fornia BioSolutions, Inc., Hayward, CA (US)

(72) Inventors: Xiyun Zhang, San Ramon, CA (US); Jie Yang, Foster City, CA (US); Khin Oo, Daly City, CA (US); Goutami Banerjee, Hayward, CA (US); Tatsuya Fukushima, Fremont, CA (US); Eric Lin Hu, Millbrae, CA (US); Marielle De Jesus Palatino, Stockton, CA (US); Jijiao Zeng, Albany, CA (US); Imad N. Sawaya, Redwood City, CA (US)

(73) Assignee: Fornia BioSolutions, Inc., Hayward, CA (US)

( * ) Notice: Subject to any disclaimer, the term of this patent is extended or adjusted under 35 U.S.C. 154(b) by 0 days.

(21) Appl. No.: 16/402,172

(22) Filed: May 2, 2019

(65) Prior Publication Data

US 2019/0338264 A1 Nov. 7, 2019

Related U.S. Application Data

(60) Provisional application No. 62/666,986, filed on May 4, 2018.

(51) Int. Cl.
| | | |
|---|---|---|
| *C12N 9/24* | (2006.01) | |
| *C12P 7/06* | (2006.01) | |
| *C12P 19/14* | (2006.01) | |
| *C11D 3/386* | (2006.01) | |
| *A21D 8/04* | (2006.01) | |

(52) U.S. Cl.
CPC ........... *C12N 9/2402* (2013.01); *A21D 8/042* (2013.01); *C11D 3/386* (2013.01); *C12P 7/06* (2013.01); *C12P 19/14* (2013.01); *C12Y 302/01001* (2013.01)

(58) Field of Classification Search
CPC .......... C12N 9/2402; C12P 19/14; C12P 7/06; C11D 3/386; C11D 3/38681; A21D 8/042; C12Y 302/01001
See application file for complete search history.

(56) References Cited

U.S. PATENT DOCUMENTS 3,912,590 A 10/1975 Slott et al.

FOREIGN PATENT DOCUMENTS

| EP | 0252730 B1 | 9/1992 |
| EP | 2290060 B1 | 12/2016 |
| WO | WO 1996/028567 A1 | 9/1996 |
| WO | WO 1999/019467 A1 | 4/1999 |

OTHER PUBLICATIONS

Zeng et al., GenBank accession No. AIF68502, Oct. 1, 2014.*
Sundarram et al., "α-Amylase Production and Applications: A Review", 2014, Journal of Applied & Environmental Microbiology, 2(4): 166-175.
GenBank accession No. AAB87860.1, amylase [*Thermococcus* sp. Rt3], retrieved from the Internet on Jan. 29, 2020. https://www.ncbi.nlm.nih.gov/protein/2655010/.
GenBank accession No. AAF44693.1, alpha-amylase [Pyrococcus woesei] retrieved from the Internet on Jan. 29, 2020. https://www.ncbi.nlm.nih.gov/protein/AAF44693.1.
GenBank accession No. AAL80601.1, alpha-amylase [Pyrococcus furiosus DSM 3638], retrieved from the Internet on Jan. 29, 2020. https://www.ncbi.nlm.nih.gov/protein/AAL80601.1.
GenBank accession No. AAM48113.1, alpha-amylase precursor [*Thermococcus* sp. 'AEPII 1a'], retrieved from the Internet on Jan. 29, 2020. https://www.ncbi.nlm.nih.gov/protein/AAM48113.1.
GenBank accession No. AAM48114.1, alpha-amylase precursor [uncultured organism], retrieved from the Internet on Jan. 29, 2020. https://www.ncbi.nlm.nih.gov/protein/AAM48114.1.
GenBank accession No. AAM48115.1, alpha-amylase precursor [synthetic construct], retrieved from the Internet on Jan. 29, 2020. https://www.ncbi.nlm.nih.gov/protein/AAM48115.1.
GenBank accession No. ABU98335.1, alpha-amylase [*Thermococcus* sp. HJ21], retrieved from the Internet on Jan. 29, 2020. https://www.ncbi.nlm.nih.gov/protein/ABU98335.1.
GenBank accession No. ACS32724.1, Alpha-amylase (amyA) [Thermococcus gammatolerans EJ3], retrieved from the Internet on Jan. 29, 2020.
GenBank accession No. AEO22190.1, alpha-amylase precursor [synthetic construct], retrieved from the Internet on Jan. 29, 2020. https://www.ncbi.nlm.nih.gov/protein/AEO22190.1.
GenBank accession No. ARF19705.1, alpha amylase [synthetic construct], retrieved from the Internet on Jan. 29, 2020. https://www.ncbi.nlm.nih.gov/protein/ARF19705.1.
NCBI Reference Sequence: WP_010479646.1, alpha-amylase [Thermococcus zilligii], retrieved from the Internet on Jan. 29, 2020. https://www.ncbi.nlm.nih.gov/protein/WP_010479646.1.
NCBI Reference Sequence: WP_011250835.1, alpha-amylase [Thermococcus kodakarensis], retrieved from the Internet on Jan. 29, 2020. https://www.ncbi.nlm.nih.gov/protein/WP_011250835.1.
NCBI Reference Sequence: WP_012572622.1, alpha-amylase [Thermococcus onnurineus], retrieved from the Internet on Jan. 29, 2020. https://www.ncbi.nlm.nih.gov/protein/WP_012572622.1.
NCBI Reference Sequence: WP_013906565.1, alpha-amylase [Pyrococcus yayanosii], retrieved from the Internet on Jan. 29, 2020. https://www.ncbi.nlm.nih.gov/protein/WP_013906565.1.
NCBI Reference Sequence: WP_014012998.1, alpha-amylase [*Thermococcus* sp. 4557] retrieved from the Internet on Jan. 29, 2020. https://www.ncbi.nlm.nih.gov/protein/WP_014012998.1.
NCBI Reference Sequence: WP_014788878.1, alpha-amylase [Thermococcus cleftensis], retrieved from the Internet on Jan. 29, 2020. https://www.ncbi.nlm.nih.gov/protein/WP_014788878.1.

(Continued)

*Primary Examiner* — Delia M Ramirez
(74) *Attorney, Agent, or Firm* — Morgan, Lewis & Bockius LLP

(57) ABSTRACT

The invention is directed to novel amylases.

11 Claims, 51 Drawing Sheets

Specification includes a Sequence Listing.

(56) References Cited

OTHER PUBLICATIONS

NCBI Reference Sequence: WP_048150489.1, alpha-amylase [*Thermococcus* sp. AM4], retrieved from the Internet on Jan. 29, 2020. https://www.ncbi.nlm.nih.gov/protein/WP_048150489.1.
NCBI Reference Sequence: WP_050002265.1, alpha-amylase [Thermococcus eurythermalis], retrieved from the Internet on Jan. 29, 2020. https://www.ncbi.nlm.nih.gov/protein/WP_050002265.1.
NCBI Reference Sequence: WP_055428342.1, alpha-amylase [Thermococcus thioreducens], retrieved from the Internet on Jan. 29, 2020. https://www.ncbi.nlm.nih.gov/protein/WP_055428342.1.
NCBI Reference Sequence: WP_058939300.1, alpha-amylase [Thermococcus celericrescens], retrieved from the Internet on Jan. 29, 2020. https://www.ncbi.nlm.nih.gov/protein/WP_058939300.1.
NCBI Reference Sequence: WP_058947441.1, alpha-amylase [*Thermococcus* sp. 2319x1], retrieved from the Internet on Jan. 29, 2020. https://www.ncbi.nlm.nih.gov/protein/WP_058947441.1.
NCBI Reference Sequence: WP_062389133.1, alpha-amylase [Thermococcus peptonophilus], retrieved from the Internet on Jan. 29, 2020. https://www.ncbi.nlm.nih.gov/protein/WP_062389133.1.
NCBI Reference Sequence: WP_084177514.1, alpha-amylase [Palaeococcus pacificus], retrieved from the Internet on Jan. 29, 2020. https://www.ncbi.nlm.nih.gov/protein/WP_084177514.1?report=genpept *Record removed. This protein record was suppressed because it is no longer annotated on any genome.
NCBI Reference Sequence: WP_084593965.1, alpha-amylase [Palaeococcus ferrophilus], retrieved from the Internet on Jan. 29, 2020. https://www.ncbi.nlm.nih.gov/protein/WP_084593965.1.
NCBI Reference Sequence: WP_088855419.1, alpha-amylase [Thermococcus siculi], retrieved from the Internet on Jan. 29, 2020. https://www.ncbi.nlm.nih.gov/protein/WP_088855419.1.
NCBI Reference Sequence: WP_088857321.1, alpha-amylase [Thermococcus profundus], retrieved from the Internet on Jan. 29, 2020. https://www.ncbi.nlm.nih.gov/protein/WP_088857321.1.
NCBI Reference Sequence: WP_088865520.1, alpha-amylase [Thermococcus barossii], retrieved from the Internet on Jan. 29, 2020. https://www.ncbi.nlm.nih.gov/protein/WP_088865520.1.
NCBI Reference Sequence: WP_088881702.1, alpha-amylase [*Thermococcus* sp. P6], retrieved from the Internet on Jan. 29, 2020. https://www.ncbi.nlm.nih.gov/protein/WP_088881702.1.

\* cited by examiner

FIGURE 2

Pre region (signal peptide)
Mature region

```
            1                                                        50
Pp.Amy  MRTGLKKVLA IFGLLL--IV LSFTAEQAIA LSPEEGGVMM QAFYWDVPEG
Pf.Amy  --MNIKKLTP LLTLLLFFIV LASPVSAAKY LELEEGGVIM QAFYWDVPGG 51                                                       100
Pp.Amy  GIWYDTIRAK IPDWAAAGIT SIWLPPPSKG MSGGYSMGYD PYDYFDLGEY
Pf.Amy  GIWWDHIRSK IPEWYEAGIS AIWLPPPSKG MSGGYSMGYD PYDYFDLGEY 101                                                      150
Pp.Amy  YQMGTVETRF GSKQELIDLI NTAHSYGLEV YADIVINHRA GGDLEWNPFV
Pf.Amy  YQKGTVETRF GSKEELVRLI QTAHAYGIKV IADVVINHRA GGDLEWNPFV 151                                                      200
Pp.Amy  NDYTWTDFSK VASGKYTANY LDFHPNELHA SDAGAFGGYP DICHDKSWDQ
Pf.Amy  GDYTWTDFSK VASGKYTANY LDFHPNELHC CDEGTFGGFP DICHHKEWDQ 201                                                      250
Pp.Amy  YWLWASSESY AAYLKSVGFD GWRFDYVKGY DPWVVKDWLS WWGGYAVGEY
Pf.Amy  YWLWKSNESY AAYLRSIGFD GWRFDYVKGY GAWVVRDWLN WWGGWAVGEY 251                                                      300
Pp.Amy  WDTNVNLVLD WIRGSGANAF DFALYYKMDE AFDNTNIPAL VSAIQNGQVL
Pf.Amy  WDTNVDALLS WAYESGAKVF DFPLYYKMDE AFDNNNIPAL VYALQNGQTV 301                                                      350
Pp.Amy  VAVDPFDAVT FVANHDTDII WNKYPAYAFI LTYEGQPTIF YRDYEEWLNK
Pf.Amy  VSRDPFKAVT FVANHDTDII WNKYPAYAFI LTYEGQPVIF YRDFEEWLNK 351                                                      400
Pp.Amy  DRLTNLIWIH NNLAGGTTEI VYYDSDELIF VRNGYGSKPG LITYINLGSG
Pf.Amy  DKLINLIWIH DHLAGGSTTI VYYDNDELIF VRNGDSRRPG LITYINLSPN 401                                                      450
Pp.Amy  WAGRWVYVPK FAGSTIHEYT GNLGGWVDKW VDSNGWVYLE APPHDPANGY
Pf.Amy  WVGRWVYVPK FAGACIHEYT GNLGGWVDKR VDSSGWVYLE APPHDPANGY 451       462
Pp.Amy  YGYSVWSYAG IG
Pf.Amy  YGYSVWSYCG VG
```

FIGURE 3

| Colony Tracking Number | Activity Improvement | Thermostability and Acid Tolerance Improvement | Activity, Thermoactivity and Acid Activity Improvement | AA Mutations w.r.t. G1P (WT) | Alias |
|---|---|---|---|---|---|
| | PF* at pH6.0, 78°C, 3hrs | PF* at pH6.0, 78°C, 3hrs after preincubation at pH4.6, 67°C for 10mins | PF* at pH4.6, 85°C, 3hrs | | |
| CL00026174 | 1.00 | 1.00 | 1.00 | | G1P |
| CL00034838 | 1.11 | 1.44 | 1.08 | E19A | |
| CL00034918 | 1.01 | 1.63 | 1.00 | N266T | |
| CL00034919 | 1.21 | 2.11 | 1.43 | R233H | |
| CL00034933 | 1.05 | 1.75 | 1.28 | N266C | |
| CL00034936 | 1.15 | 1.95 | 1.05 | A417G | |
| CL00034950 | 1.06 | 1.14 | 1.33 | E19D | |
| CL00035000 | 1.53 | 2.46 | 2.09 | Y420T | G1V5 |
| CL00035021 | 1.38 | 1.91 | 1.92 | N325Y | |
| CL00035092 | 1.17 | 1.42 | 1.42 | Y420L | |
| CL00035110 | 1.02 | 1.16 | 1.20 | Y71W | |
| CL00035119 | 1.38 | 2.14 | 2.11 | N325V | |
| CL00035153 | 1.21 | 1.57 | 1.17 | G394N | |
| CL00035195 | 1.32 | 1.58 | 1.87 | G394T | |
| CL00035200 | 1.17 | 1.28 | 1.41 | N325F | |
| CL00035271 | 1.00 | 1.03 | 1.27 | K130R | |
| CL00035301 | 1.42 | 2.00 | 2.10 | N325T | |
| CL00035364 | 1.28 | 1.65 | 1.62 | G394P | |
| CL00035374 | 1.56 | 2.11 | 2.45 | N325R | G1V2 |
| CL00035764 | 1.33 | 2.51 | 2.10 | I22A | G1V4 |
| CL00035771 | 1.14 | 2.44 | 5.22 | D165N | G1V3 |
| CL00036023 | 1.16 | 1.38 | 3.83 | D165R | G1V1 (G2P) |

FIGURE 4

| Colony Tracking Number | Activity and Acid Activity Improvement | Thermostability and Acid Tolerance Improvement | Activity, Thermoactivity and Acid Activity Improvement | AA Mutations w.r.t. G2P | Alias |
|---|---|---|---|---|---|
| | PF at pH4.6, 85°C, 3hrs | PF at pH4.6, 85°C, 3hrs after preincubation at pH4.6, 88°C for 10mins | PF at pH4.6, 95°C, 3hrs | | |
| CL00036023 | 1.00 | 1.00 | 1.00 | | G2P |
| CL00037324 | 1.26 | 1.40 | 1.49 | N325A | |
| CL00037336 | 1.32 | 1.37 | 1.86 | N325L | |
| CL00037348 | 1.24 | 1.42 | 1.55 | N325G | |
| CL00037355 | 1.25 | 1.35 | 1.67 | N325C | |
| CL00037383 | 1.14 | 1.15 | 1.31 | P18T | |
| CL00037385 | 1.36 | 1.57 | 1.78 | N325K | |
| CL00037406 | 1.07 | 1.24 | 1.18 | A175N | |
| CL00037470 | 1.32 | 1.39 | 1.63 | N325S | |
| CL00037593 | 1.22 | 1.36 | 1.47 | N325T | |
| CL00037702 | 1.30 | 1.44 | 1.73 | N325R | G2V1 (G3P) |
| CL00037744 | 1.22 | 1.43 | 1.86 | N325M | |
| CL00037752 | 1.09 | 1.09 | 1.12 | S262R | |
| CL00037766 | 1.11 | 1.26 | 1.48 | N325F | |
| CL00037822 | 1.37 | 1.52 | 1.62 | N325H | |
| CL00038189 | 1.47 | 1.64 | 1.80 | N325P | |
| CL00038223 | 1.44 | 1.68 | 1.91 | P18T/N325L | |
| CL00038924 | 1.08 | 1.01 | 1.11 | G54F | |
| CL00039053 | 1.43 | 1.61 | 1.41 | G54N | |
| CL00039248 | 1.36 | 1.41 | 1.25 | D321T | |
| CL00039301 | 1.13 | 1.18 | 1.10 | Y377H | |
| CL00039390 | 1.37 | 1.44 | 1.30 | P18T/Y377C | |
| CL00039414 | 1.08 | 1.17 | 1.02 | G54S | |

FIGURE 5A

| Colony Tracking Number | Activity and Acid Activity Improvement | Thermostability and Acid Tolerance Improvement | Activity, Thermoactivity and Acid Activity Improvement | AA Mutations w.r.t. G3P | Alias |
| --- | --- | --- | --- | --- | --- |
| | PF at pH4.6, 85°C, 3hrs | PF at pH4.6, 85°C, 3hrs after preincubation at pH4.6, 96°C for 10mins | PF at pH4.6, 95°C, 3hrs | | |
| CL00037702 | 1.00 | 1.00 | 1.00 | | G3P |
| CL00044971 | 1.24 | 1.15 | 1.36 | L393N/G395E | |
| CL00044986 | 1.26 | 1.34 | 1.44 | L393K | |
| CL00045052 | 1.18 | 1.14 | 1.28 | N392K/L393R | |
| CL00045079 | 1.23 | 1.37 | 1.17 | L393Q | |
| CL00045095 | 1.10 | 1.19 | 1.01 | A372S | |
| CL00045235 | 1.12 | 1.06 | 1.04 | A372P | |
| CL00045254 | 1.49 | 1.76 | 1.74 | L393P | |
| CL00045306 | 1.13 | 1.43 | 1.21 | A35V | |
| CL00045321 | 1.18 | 1.19 | 1.34 | L393S | |
| CL00045326 | 1.11 | 1.08 | 1.15 | L393A | |
| CL00045373 | 1.26 | 1.81 | 1.69 | L393E | |
| CL00045482 | 1.25 | 1.61 | 1.31 | S384T | |
| CL00045491 | 1.17 | 1.47 | 1.34 | L393R | |
| CL00045496 | 1.16 | 1.49 | 1.16 | V187I | |
| CL00045673 | 1.77 | 2.46 | 2.09 | T75S | |
| CL00045765 | 1.26 | 1.65 | 1.15 | V271M | |
| CL00046070 | 1.10 | 1.35 | 1.00 | V378C | |
| CL00046087 | 1.01 | 1.09 | 1.04 | A182W | |
| CL00046208 | 1.19 | 1.29 | 1.17 | V271S | |
| CL00046591 | 1.15 | 1.03 | 1.21 | V351T | |
| CL00046878 | 1.18 | 1.15 | 1.03 | I232K | |
| CL00046932 | 1.64 | 2.44 | 2.21 | P18T/A175N/Y377C | |
| CL00046960 | 1.44 | 1.99 | 1.70 | G54N/Y377Q | |
| CL00046965 | 1.31 | 1.87 | 1.72 | A175N | |
| CL00047034 | 1.35 | 1.98 | 1.55 | G54N/Y377H | |
| CL00047043 | 1.36 | 1.71 | 1.50 | P18T/G54N | |
| CL00047052 | 1.50 | 2.28 | 2.00 | G54N/Y377C | |
| CL00047056 | 1.57 | 2.13 | 2.09 | P18T/G54N/R325K/Y377Q | |
| CL00047106 | 1.23 | 1.52 | 1.32 | P18T/Y377C | |

FIGURE 5B

| Colony Tracking Number | Activity and Acid Activity Improvement | Thermostability and Acid Tolerance Improvement | Activity, Thermoactivity and Acid Activity Improvement | AA Mutations w.r.t. G3P | Alias |
|---|---|---|---|---|---|
| | PF at pH4.6, 85°C, 3hrs | PF at pH4.6, 85°C, 3hrs after preincubation at pH4.6, 96°C for 10mins | PF at pH4.6, 95°C, 3hrs | | |
| CL00047134 | 1.24 | 1.90 | 1.43 | P18T/G54N/D321T | |
| CL00047179 | 1.41 | 2.31 | 1.63 | G54N/A175N | |
| CL00047183 | 1.54 | 2.31 | 1.95 | A175N/R325H/Y377C | |
| CL00047186 | 1.38 | 1.65 | 1.40 | P18T/G54F/A175N/D321T/Y377C | |
| CL00047217 | 1.38 | 1.56 | 1.58 | P18T/A175N | |
| CL00047252 | 1.15 | 1.04 | 1.10 | Y377H | |
| CL00047281 | 1.50 | 1.73 | 1.86 | A175N/Y377C | |
| CL00047285 | 1.25 | 1.26 | 1.27 | G54F/A175N | |
| CL00047289 | 1.32 | 1.61 | 1.44 | G54F/A175N/D321T/R325L/Y377C | |
| CL00047307 | 1.34 | 1.85 | 1.69 | G54N | |
| CL00047348 | 1.32 | 1.65 | 1.46 | S262R/D321T/Y377H | |
| CL00047356 | 1.40 | 2.13 | 1.77 | G54N/R325L/Y377H | |
| CL00047406 | 1.20 | 1.12 | 1.17 | S262R | |

FIGURE 6A

| Colony Tracking Number | Activity Improvement | Thermostability Improvement | Thermoactivity Improvement | Activity, Thermoactivity and Acid Activity Improvement | AA Mutations w.r.t. G1P (WT) | Alias |
|---|---|---|---|---|---|---|
| | PF at pH6.0, 70°C, 4hrs | PF at pH6.0, 70°C, 4hrs after preincubation at 100°C for 35mins | PF at pH6.0, 100°C, 3hrs | PF at pH4.6, 100°C, 3hrs | | |
| CL00049011 | 1.00 | 1.00 | 1.00 | 1.00 | | G1P |
| CL00050734 | 1.05 | 0.94 | 1.02 | 1.06 | Y67L | |
| CL00050960 | 2.03 | 1.41 | 1.72 | 2.12 | D19K | G1V2 |
| CL00051180 | 1.31 | 1.05 | 1.43 | 1.65 | F83L | |
| CL00052897 | 1.16 | 0.90 | 1.20 | 1.44 | V107I/Q271D/F317Y/K383N | |
| CL00052900 | 1.18 | 0.82 | 1.16 | 1.58 | S275K/K383N | |
| CL00052961 | 1.27 | 0.82 | 1.10 | 1.35 | Y139F/K383N | |
| CL00052982 | 1.36 | 1.32 | 1.50 | 1.65 | V107I/Y306H/K383N | G1V1 |
| CL00053009 | 1.20 | 0.98 | 1.24 | 1.44 | V107I/Y139F/Q271D/K383N | |
| CL00053023 | 1.34 | 1.05 | 1.26 | 1.30 | V107I/Y306H | |
| CL00053036 | 1.03 | 0.84 | 1.12 | 1.12 | V107I | |
| CL00053038 | 1.26 | 1.42 | 1.48 | 1.39 | Y306H/K383N | |
| CL00053062 | 1.21 | 1.09 | 1.09 | 1.22 | L351Y/K383N | |
| CL00053076 | 1.18 | 1.15 | 1.33 | 1.19 | Y306H | |
| CL00053098 | 1.09 | 0.97 | 1.13 | 1.05 | V107I/Y139F | |
| CL00053179 | 1.43 | 1.05 | 1.18 | 1.11 | S275K | |
| CL00053182 | 1.27 | 1.01 | 1.27 | 1.29 | Y139F | |
| CL00053295 | 1.49 | 1.21 | 1.38 | 1.47 | Y139F/Y306H | |
| CL00053353 | 1.42 | 1.01 | 1.23 | 1.27 | Y139F/S275K | |
| CL00053441 | 1.49 | 1.31 | 1.00 | 1.00 | F317Y | |
| CL00053513 | 1.20 | 1.08 | 1.07 | 1.03 | V107I/K383N | |
| CL00053515 | 1.16 | 1.08 | 1.15 | 1.27 | K383N | |
| CL00053955 | 1.12 | 0.71 | 1.12 | 1.02 | A113S/V344L/F384W | |
| CL00054030 | 1.01 | 1.00 | 1.11 | 1.17 | K280Q/V344L/L396S | |
| CL00054048 | 1.26 | 0.94 | 1.36 | 1.63 | T272N/V344L | |
| CL00054092 | 1.12 | 0.73 | 1.10 | 1.22 | A113S | |
| CL00054095 | 1.28 | 0.89 | 1.22 | 1.47 | G338D/F384W | |
| CL00054107 | 1.43 | 0.76 | 1.19 | 1.27 | A113S/V344L | |

FIGURE 6B

| Colony Tracking Number | Activity Improvement | Thermostability Improvement | Thermoactivity Improvement | Activity, Thermoactivity and Acid Activity Improvement | AA Mutations w.r.t. G1P (WT) | Alias |
|---|---|---|---|---|---|---|
| | PF at pH6.0, 70°C, 4hrs | PF at pH6.0, 70°C, 4hrs after preincubation at 100°C for 35mins | PF at pH6.0, 100°C, 3hrs | PF at pH4.6, 100°C, 3hrs | | |
| CL00054111 | 1.32 | 0.95 | 1.18 | 1.01 | F384W/L396S | |
| CL00054116 | 1.05 | 1.01 | 1.12 | 1.06 | L396S | |
| CL00054126 | 1.13 | 1.07 | 1.13 | 1.12 | T272M | |

FIGURE 7

| Position | Wild type residue in Pp.Amy | Particular variants |
|---|---|---|
| 18 | P | T |
| 19 | E | A, D |
| 22 | I | A |
| 35 | A | V |
| 54 | G | F, N, S |
| 71 | Y | W |
| 75 | T | S |
| 130 | K | R |
| 165 | D | N, R |
| 175 | A | N |
| 182 | A | W |
| 187 | V | I |
| 232 | I | K |
| 233 | R | H |
| 262 | S | R |
| 266 | N | C, T |
| 271 | V | M, S |
| 321 | D | T |
| 325 | N | A, C, F, G, H, K, L, M, P, R, S, T, V, Y |
| 351 | V | T |
| 372 | A | P, S |
| 377 | Y | C, H, Q |
| 378 | V | C |
| 384 | S | T |
| 392 | N | K |
| 393 | L | A, E, K, N, P, Q, R, S |
| 394 | G | N, P, T |
| 395 | G | E |
| 417 | A | G |
| 420 | Y | L, T |

FIGURE 8

| Position | Wild type residue in Pf.Amy | Particular variants |
|---|---|---|
| 19 | D | K |
| 67 | Y | L |
| 83 | F | L |
| 107 | V | I |
| 113 | A | S |
| 139 | Y | F |
| 271 | Q | D |
| 272 | T | N |
| 272 | T | M |
| 275 | S | K |
| 280 | K | Q |
| 306 | Y | H |
| 317 | F | Y |
| 338 | G | D |
| 344 | V | L |
| 351 | L | Y |
| 383 | K | N |
| 384 | F | W |
| 396 | L | S |

FIGURE 9

| Accession # | %Sequence Identity to Pp.Amy |
|---|---|
| AAM48114.1 | 85.0 |
| WP_055428342.1 | 84.5 |
| WP_014788878.1 | 83.8 |
| WP_058939300.1 | 83.6 |
| ABU98335.1 | 83.6 |
| AAM48115.1 | 83.3 |
| WP_084593965.1 | 82.6 |
| AAB87860.1 | 82.4 |
| WP_010479646.1 | 82.2 |
| WP_014012998.1 | 82.2 |
| WP_088865520.1 | 81.7 |
| Pf.Amy | 81.5 |
| AAL80601.1 | 81.5 |
| WP_050002265.1 | 81.5 |

FIGURE 10

| Accession # | %Sequence Identity to Pf.Amy |
|---|---|
| AAF44693.1 | 99.8 |
| WP_062389133.1 | 89.9 |
| WP_011250835.1 | 89.2 |
| AAM48113.1 | 89.0 |
| WP_050002265.1 | 88.5 |
| WP_088855419.1 | 88.0 |
| WP_014012998.1 | 87.8 |
| ABU98335.1 | 87.6 |
| WP_013906565.1 | 87.4 |
| WP_058939300.1 | 87.4 |
| AEO22190.1 | 87.2 |
| WP_058947441.1 | 87.1 |
| WP_055428342.1 | 87.1 |
| WP_014788878.1 | 86.9 |
| WP_084593965.1 | 86.7 |
| AAM48115.1 | 86.7 |
| AAM48114.1 | 86.0 |
| WP_088865520.1 | 86.0 |
| WP_010479646.1 | 85.5 |
| AAB87860.1 | 85.3 |
| WP_088881702.1 | 85.3 |
| WP_088857321.1 | 85.1 |
| ARF19705.1 | 84.8 |
| WP_012572622.1 | 84.8 |
| WP_048150489.1 | 83.5 |
| ACS32724.1 | 82.6 |
| WP_084177514.1 | 81.1 |
| Pp.Amy | 80.9 |

FIGURE 11A

>CL00026174 Pp.Amy G1P (SEQ ID NO:1)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00034838 (SEQ ID NO:11)
LSPEEGGVMMQAFYWDVPAGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00034918 (SEQ ID NO:12)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQTGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00034919 (SEQ ID NO:13)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIHGSGANAF
DFALYYKMDEAFDNTNIPALVSAIQNGQVLVAVDPFDAVTFVANHDTDIIWNKYPAYAFILT
YEGQPTIFYRDYEEWLNKDRLTNLIWIHNNLAGGTTEIVYYDSDELIFVRNGYGSKPGLITYIN
LGSGWAGRWVYVPKFAGSTIHEYTGNLGGWVDKWVDSNGWVYLEAPPHDPANGYYGYSV
WSYAGIG**

FIGURE 11B

>CL00034933 (SEQ ID NO:14)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQCGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00034936 (SEQ ID NO:15)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPGNGYYGYSV
WSYAGIG**

>CL00034950 (SEQ ID NO:16)
LSPEEGGVMMQAFYWDVPDGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00035000 Pp.Amy G1V5 (SEQ ID NO:8)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGTYGYSV
WSYAGIG**

FIGURE 11C

>CL00035021 (SEQ ID NO:17)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTYLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00035092 (SEQ ID NO:18)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGLYGYSV
WSYAGIG**

>CL00035110 (SEQ ID NO:19)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVND
YTWTDFSKVASGKYTANYLDFHPNELHASDAGAFGGYPDICHDKSWDQYWLWASSESYAA
YLKSVGFDGWRFDYVKGYDPWVVKDWLSWWGGYAVGEYWDTNVNLVLDWIRGSGANAF
DFALYYKMDEAFDNTNIPALVSAIQNGQVLVAVDPFDAVTFVANHDTDIIWNKYPAYAFILT
YEGQPTIFYRDYEEWLNKDRLTNLIWIHNNLAGGTTEIVYYDSDELIFVRNGYGSKPGLITYIN
LGSGWAGRWVYVPKFAGSTIHEYTGNLGGWVDKWVDSNGWVYLEAPPHDPANGYYGYSV
WSYAGIG**

>CL00035119 (SEQ ID NO:20)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTVLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11D

>CL00035153 (SEQ ID NO:21)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLNGWVDKWVDSNGWVYLEAPPHDPANGYYGYSV
WSYAGIG**

>CL00035195 (SEQ ID NO:22)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLTGWVDKWVDSNGWVYLEAPPHDPANGYYGYSV
WSYAGIG**

>CL00035200 (SEQ ID NO:23)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTFLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00035271 (SEQ ID NO:24)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSRVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11E

>CL00035301 (SEQ ID NO:25)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTTLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00035364 (SEQ ID NO:26)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLPGWVDKWVDSNGWVYLEAPPHDPANGYYGYSV
WSYAGIG**

>CL00035374 Pp.Amy G1V2 (SEQ ID NO:5)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00035764 Pp.Amy G1V4 (SEQ ID NO:7)
LSPEEGGVMMQAFYWDVPEGGAWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHDKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11F

>CL00035771 Pp.Amy G1V3 (SEQ ID NO:6)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHNKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00036023 Pp.Amy G1V1 (G2P) (SEQ ID NO:2)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037324 (SEQ ID NO:27)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTALIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037336 (SEQ ID NO:28)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTLLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11G

>CL00037348 (SEQ ID NO:29)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTGLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037355 (SEQ ID NO:30)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTCLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037383 (SEQ ID NO:31)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037385 (SEQ ID NO:32)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTKLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11H

>CL00037406 (SEQ ID NO:33)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037470 (SEQ ID NO:34)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTSLIWIHNNLAGGTTEIVYYDSDELIFVRNGYGSKPGLITYINLG
SGWAGRWVYVPKFAGSTIHEYTGNLGGWVDKWVDSNGWVYLEAPPHDPANGYYGYSVWS
YAGIG**

>CL00037593 (SEQ ID NO:35)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTTLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037702 Pp.Amy G2V1 (G3P) (SEQ ID NO:3)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11I

>CL00037744 (SEQ ID NO:36)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTMLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037752 (SEQ ID NO:37)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVRAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037766 (SEQ ID NO:38)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTFLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00037822 (SEQ ID NO:39)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTHLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11J

\>CL00038189 (SEQ ID NO:40)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTPLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

\>CL00038223 (SEQ ID NO:41)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTLLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

\>CL00038924 (SEQ ID NO:42)
LSPEEGGVMMQAFYWDVPEGGIWYDTIRAKIPDWAAAGITSIWLPPPSKGMSGFYSMGYDPY
DYFDLGEYYQMGTVETRFGSKQELIDLINTAHSYGLEVYADIVINHRAGGDLEWNPFVNDYT
WTDFSKVASGKYTANYLDFHPNELHASDAGAFGGYPDICHRKSWDQYWLWASSESYAAYL
KSVGFDGWRFDYVKGYDPWVVKDWLSWWGGYAVGEYWDTNVNLVLDWIRGSGANAFDF
ALYYKMDEAFDNTNIPALVSAIQNGQVLVAVDPFDAVTFVANHDTDIIWNKYPAYAFILTYE
GQPTIFYRDYEEWLNKDRLTNLIWIHNNLAGGTTEIVYYDSDELIFVRNGYGSKPGLITYINLG
SGWAGRWVYVPKFAGSTIHEYTGNLGGWVDKWVDSNGWVYLEAPPHDPANGYYGYSVWS
YAGIG**

\>CL00039053 (SEQ ID NO:43)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11K

>CL00039248 (SEQ ID NO:44)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKTRLTNLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00039301 (SEQ ID NO:45)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVHVPKFAGSTIHEYTGNLGGWVDKWVDSNGWVYLEAPPHDPANGYYGYSV
WSYAGIG**

>CL00039390 (SEQ ID NO:46)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTNLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

>CL00039414 (SEQ ID NO:47)
LSPEEGGVMMQAFYWDVPEGGIWYDTIRAKIPDWAAAGITSIWLPPPSKGMSGSYSMGYDPY
DYFDLGEYYQMGTVETRFGSKQELIDLINTAHSYGLEVYADIVINHRAGGDLEWNPFVNDYT
WTDFSKVASGKYTANYLDFHPNELHASDAGAFGGYPDICHRKSWDQYWLWASSESYAAYL
KSVGFDGWRFDYVKGYDPWVVKDWLSWWGGYAVGEYWDTNVNLVLDWIRGSGANAFDF
ALYYKMDEAFDNTNIPALVSAIQNGQVLVAVDPFDAVTFVANHDTDIIWNKYPAYAFILTYE
GQPTIFYRDYEEWLNKDRLTNLIWIHNNLAGGTTEIVYYDSDELIFVRNGYGSKPGLITYINLG
SGWAGRWVYVPKFAGSTIHEYTGNLGGWVDKWVDSNGWVYLEAPPHDPANGYYGYSVWS
YAGIG**

FIGURE 11L

>CL00044971 (SEQ ID NO:48)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNNGEWVDKWVDSNGWVYLEAPPHDPANGYYGYSV
WSYAGIG**

>CL00044986 (SEQ ID NO:49)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNKGGWVDKWVDSNGWVYLEAPPHDPANGYYGYSV
WSYAGIG**

>CL00045052 (SEQ ID NO:50)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGKRGGWVDKWVDSNGWVYLEAPPHDPANGYYGYSV
WSYAGIG**

>CL00045079 (SEQ ID NO:51)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNQGGWVDKWVDSNGWVYLEAPPHDPANGYYGYSV
WSYAGIG**

FIGURE 11M

>CL00045095 (SEQ ID NO:52)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWSGRWVYVPKFAGSTIHEYTGNLGGWVDKWVDSNGWVYLEAPPHDPANGYYGYSVW
SYAGIG**

>CL00045235 (SEQ ID NO:53)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWPGRWVYVPKFAGSTIHEYTGNLGGWVDKWVDSNGWVYLEAPPHDPANGYYGYSV
WSYAGIG**

>CL00045254 (SEQ ID NO:54)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNPGGWVDKWVDSNGWVYLEAPPHDPANGYYGYSV
WSYAGIG**

>CL00045306 (SEQ ID NO:55)
LSPEEGGVMMQAFYWDVPEGGIWYDTIRAKIPDWVAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11N

>CL00045321 (SEQ ID NO:56)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNSGGWVDKWVDSNGWVYLEAPPHDPANGYYGYSV
WSYAGIG**

>CL00045326 (SEQ ID NO:57)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNAGGWVDKWVDSNGWVYLEAPPHDPANGYYGYSV
WSYAGIG**

>CL00045373 (SEQ ID NO:58)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNEGGWVDKWVDSNGWVYLEAPPHDPANGYYGYSV
WSYAGIG**

>CL00045482 (SEQ ID NO:59)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGTTIHEYTGNLGGWVDKWVDSNGWVYLEAPPHDPANGYYGYSV
WSYAGIG**

FIGURE 11O

>CL00045491 (SEQ ID NO:60)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNRGGWVDKWVDSNGWVYLEAPPHDPANGYYGYSV
WSYAGIG**

>CL00045496 (SEQ ID NO:61)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSIGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00045673 (SEQ ID NO:62)
LSPEEGGVMMQAFYWDVPEGGIWYDTIRAKIPDWAAAGITSIWLPPPSKGMSGGYSMGYDP
YDYFDLGEYYQMGSVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00045765 (SEQ ID NO:63)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLMAVDPFDAVTFVANHDTDIIWNKYPAYAFILT
YEGQPTIFYRDYEEWLNKDRLTRLIWIHNNLAGGTTEIVYYDSDELIFVRNGYGSKPGLITYIN
LGSGWAGRWVYVPKFAGSTIHEYTGNLGGWVDKWVDSNGWVYLEAPPHDPANGYYGYSV
WSYAGIG**

FIGURE 11P

>CL00046070 (SEQ ID NO:64)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYCPKFAGSTIHEYTGNLGGWVDKWVDSNGWVYLEAPPHDPANGYYGYSV
WSYAGIG**

>CL00046087 (SEQ ID NO:65)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAWY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00046208 (SEQ ID NO:66)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLSAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00046591 (SEQ ID NO:67)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFTRNGYGSKPGLITYINL
GSGWAGRWVYVPKFAGSTIHEYTGNLGGWVDKWVDSNGWVYLEAPPHDPANGYYGYSV
WSYAGIG**

FIGURE 11Q

>CL00046878 (SEQ ID NO:68)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWKRGSGANAF
DFALYYKMDEAFDNTNIPALVSAIQNGQVLVAVDPFDAVTFVANHDTDIIWNKYPAYAFILT
YEGQPTIFYRDYEEWLNKDRLTRLIWIHNNLAGGTTEIVYYDSDELIFVRNGYGSKPGLITYIN
LGSGWAGRWVYVPKFAGSTIHEYTGNLGGWVDKWVDSNGWVYLEAPPHDPANGYYGYSV
WSYAGIG**

>CL00046932 (SEQ ID NO:69)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

>CL00046960 (SEQ ID NO:70)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVQVPKFAGSTIHEYTGNLGGWVDKWVDSNGWVYLEAPPHDPANGYYGYSV
WSYAGIG**

>CL00046965 (SEQ ID NO:71)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 11R

>CL00047034 (SEQ ID NO:117)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVHVPKFAGSTIHEYTGNLGGWVDKWVDSNGWVYLEAPPHDPANGYYGYSV
WSYAGIG**

>CL00047043 (SEQ ID NO:72)
LSPEEGGVMMQAFYWDVTEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00047052 (SEQ ID NO:73)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

>CL00047056 (SEQ ID NO:74)
LSPEEGGVMMQAFYWDVTEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTKLIWIHNNLAGGTTEIVYYDSDELIFVRNGYGSKPGLITYINL
GSGWAGRWVQVPKFAGSTIHEYTGNLGGWVDKWVDSNGWVYLEAPPHDPANGYYGYSV
WSYAGIG**

FIGURE 11S

>CL00047106 (SEQ ID NO:75)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

>CL00047134 (SEQ ID NO:76)
LSPEEGGVMMQAFYWDVTEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKTRLTRLIWIHNNLAGGTTEIVYYDSDELIFVRNGYGSKPGLITYINLG
SGWAGRWVYVPKFAGSTIHEYTGNLGGWVDKWVDSNGWVYLEAPPHDPANGYYGYSVWS
YAGIG**

>CL00047179 (SEQ ID NO:77)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

>CL00047183 (SEQ ID NO:78)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTHLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

FIGURE 11T

\>CL00047186 (SEQ ID NO:79)
LSPEEGGVMMQAFYWDVTEGGIWYDTIRAKIPDWAAAGITSIWLPPPSKGMSGFYSMGYDPY
DYFDLGEYYQMGTVETRFGSKQELIDLINTAHSYGLEVYADIVINHRAGGDLEWNPFVNDYT
WTDFSKVASGKYTANYLDFHPNELHASDAGAFGGYPDICHRKSWDQYWLWNSSESYAAYL
KSVGFDGWRFDYVKGYDPWVVKDWLSWWGGYAVGEYWDTNVNLVLDWIRGSGANAFDF
ALYYKMDEAFDNTNIPALVSAIQNGQVLVAVDPFDAVTFVANHDTDIIWNKYPAYAFILTYE
GQPTIFYRDYEEWLNKTRLTRLIWIHNNLAGGTTEIVYYDSDELIFVRNGYGSKPGLITYINLGS
GWAGRWVCVPKFAGSTIHEYTGNLGGWVDKWVDSNGWVYLEAPPHDPANGYYGYSVWS
YAGIG**

\>CL00047217 (SEQ ID NO:80)
LSPEEGGVMMQAFYWDVTEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

\>CL00047252 (SEQ ID NO:81)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVHVPKFAGSTIHEYTGNLGGWVDKWVDSNGWVYLEAPPHDPANGYYGYSV
WSYAGIG**

\>CL00047281 (SEQ ID NO:82)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWNSSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVCVPKFAGSTIHEYTGNLGGWVDKWVDSNGWVYLEAPPHDPANGYYGYSV
WSYAGIG**

FIGURE 11U

>CL00047285 (SEQ ID NO:83)
LSPEEGGVMMQAFYWDVPEGGIWYDTIRAKIPDWAAAGITSIWLPPPSKGMSGFYSMGYDPY
DYFDLGEYYQMGTVETRFGSKQELIDLINTAHSYGLEVYADIVINHRAGGDLEWNPFVNDYT
WTDFSKVASGKYTANYLDFHPNELHASDAGAFGGYPDICHRKSWDQYWLWNSSESYAAYL
KSVGFDGWRFDYVKGYDPWVVKDWLSWWGGYAVGEYWDTNVNLVLDWIRGSGANAFDF
ALYYKMDEAFDNTNIPALVSAIQNGQVLVAVDPFDAVTFVANHDTDIIWNKYPAYAFILTYE
GQPTIFYRDYEEWLNKDRLTRLIWIHNNLAGGTTEIVYYDSDELIFVRNGYGSKPGLITYINLG
SGWAGRWVYVPKFAGSTIHEYTGNLGGWVDKWVDSNGWVYLEAPPHDPANGYYGYSVWS
YAGIG\*\*

>CL00047289 (SEQ ID NO:84)
LSPEEGGVMMQAFYWDVPEGGIWYDTIRAKIPDWAAAGITSIWLPPPSKGMSGFYSMGYDPY
DYFDLGEYYQMGTVETRFGSKQELIDLINTAHSYGLEVYADIVINHRAGGDLEWNPFVNDYT
WTDFSKVASGKYTANYLDFHPNELHASDAGAFGGYPDICHRKSWDQYWLWNSSESYAAYL
KSVGFDGWRFDYVKGYDPWVVKDWLSWWGGYAVGEYWDTNVNLVLDWIRGSGANAFDF
ALYYKMDEAFDNTNIPALVSAIQNGQVLVAVDPFDAVTFVANHDTDIIWNKYPAYAFILTYE
GQPTIFYRDYEEWLNKTRLTLLIWIHNNLAGGTTEIVYYDSDELIFVRNGYGSKPGLITYINLGS
GWAGRWVCVPKFAGSTIHEYTGNLGGWVDKWVDSNGWVYLEAPPHDPANGYYGYSVWS
YAGIG\*\*

>CL00047307 (SEQ ID NO:85)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG\*\*

>CL00047348 (SEQ ID NO:86)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVRAIQNGQVLVAVDPFDAVTFVANHDTDIIWNKYPAYAFILTY
EGQPTIFYRDYEEWLNKTRLTRLIWIHNNLAGGTTEIVYYDSDELIFVRNGYGSKPGLITYINLG
SGWAGRWVHVPKFAGSTIHEYTGNLGGWVDKWVDSNGWVYLEAPPHDPANGYYGYSVW
SYAGIG\*\*

FIGURE 11V

>CL00047356 (SEQ ID NO:87)
LSPEEGGVMMQAFYWDVPEGGIWYDTIRAKIPDWAAAGITSIWLPPPSKGMSGNYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVSAIQNGQVLVAVDPFDAVTFVANHDTDIIWNKYPAYAFILTY
EGQPTIFYRDYEEWLNKDRLTLLIWIHNNLAGGTTEIVYYDSDELIFVRNGYGSKPGLITYINL
GSGWAGRWVHVPKFAGSTIHEYTGNLGGWVDKWVDSNGWVYLEAPPHDPANGYYGYSV
WSYAGIG**

>CL00047406 (SEQ ID NO:88)
LSPEEGGVMMQAFYWDVPEGGIWYDTIRAKIPDWAAAGITSIWLPPPSKGMSGGYSMGYDP
YDYFDLGEYYQMGTVETRFGSKQELIDLINTAHSYGLEVYADIVINHRAGGDLEWNPFVNDY
TWTDFSKVASGKYTANYLDFHPNELHASDAGAFGGYPDICHRKSWDQYWLWASSESYAAY
LKSVGFDGWRFDYVKGYDPWVVKDWLSWWGGYAVGEYWDTNVNLVLDWIRGSGANAFD
FALYYKMDEAFDNTNIPALVRAIQNGQVLVAVDPFDAVTFVANHDTDIIWNKYPAYAFILTY
EGQPTIFYRDYEEWLNKDRLTRLIWIHNNLAGGTTEIVYYDSDELIFVRNGYGSKPGLITYINL
GSGWAGRWVYVPKFAGSTIHEYTGNLGGWVDKWVDSNGWVYLEAPPHDPANGYYGYSV
WSYAGIG**

FIGURE 12A

>CL00049011 Pf.Amy G1P (SEQ ID NO:4)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00050734 (SEQ ID NO:89)
AKYLELEEGGVIMQAFYWDVPGGGIWWDHIRSKIPEWYEAGISAIWLPPPSKGMSGGYSMGY
DPYDLFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00050960 Pf.Amy G1V2 (SEQ ID NO:10)
AKYLELEEGGVIMQAFYWKVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00051180 (SEQ ID NO:90)
AKYLELEEGGVIMQAFYWDVPGGGIWWDHIRSKIPEWYEAGISAIWLPPPSKGMSGGYSMGY
DPYDYFDLGEYYQKGTVETRLGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

FIGURE 12B

\>CL00052897 (SEQ ID NO:91)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKYTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGDTVVSRDPFKAVTFVANHDTDIIWNKYPAYAFILT
YEGQPVIFYRDYEEWLNKDKLINLIWIHDHLAGGSTTIVYYDNDELIFVRNGDSRRPGLITYIN
LSPNWVGRWVYVPNFAGACIHEYTGNLGGWVDKRVDSSGWVYLEAPPHDPANGYYGYSV
WSYCGVG**

\>CL00052900 (SEQ ID NO:92)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVKRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPNFAGACIHEYTGNLGGWVDKRVDSSGWVYLEAPPHDPANGYYGYS
VWSYCGVG**

\>CL00052961 (SEQ ID NO:93)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKFTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPNFAGACIHEYTGNLGGWVDKRVDSSGWVYLEAPPHDPANGYYGYS
VWSYCGVG**

\>CL00052982 Pf.Amy G1V1 (SEQ ID NO:9)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKYTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGQTVVSRDPFKAVTFVANHDTDIIWNKYPAYAFIL
THEGQPVIFYRDFEEWLNKDKLINLIWIHDHLAGGSTTIVYYDNDELIFVRNGDSRRPGLITYI
NLSPNWVGRWVYVPNFAGACIHEYTGNLGGWVDKRVDSSGWVYLEAPPHDPANGYYGYS
VWSYCGVG**

FIGURE 12C

>CL00053009 (SEQ ID NO:94)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKFTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGDTVVSRDPFKAVTFVANHDTDIIWNKYPAYAFILT
YEGQPVIFYRDFEEWLNKDKLINLIWIHDHLAGGSTTIVYYDNDELIFVRNGDSRRPGLITYIN
LSPNWVGRWVYVPNFAGACIHEYTGNLGGWVDKRVDSSGWVYLEAPPHDPANGYYGYSV
WSYCGVG**

>CL00053023 (SEQ ID NO:95)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKYTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGQTVVSRDPFKAVTFVANHDTDIIWNKYPAYAFIL
THEGQPVIFYRDFEEWLNKDKLINLIWIHDHLAGGSTTIVYYDNDELIFVRNGDSRRPGLITYI
NLSPNWVGRWVYVPKFAGACIHEYTGNLGGWVDKRVDSSGWVYLEAPPHDPANGYYGYS
VWSYCGVG**

>CL00053036 (SEQ ID NO:96)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKYTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGQTVVSRDPFKAVTFVANHDTDIIWNKYPAYAFIL
TYEGQPVIFYRDFEEWLNKDKLINLIWIHDHLAGGSTTIVYYDNDELIFVRNGDSRRPGLITYI
NLSPNWVGRWVYVPKFAGACIHEYTGNLGGWVDKRVDSSGWVYLEAPPHDPANGYYGYS
VWSYCGVG**

>CL00053038 (SEQ ID NO:97)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTHEGQPVIFYRDFEEWLNKDKLINLIWIHDHLAGGSTTIVYYDNDELIFVRNGDSRRPGLIT
YINLSPNWVGRWVYVPNFAGACIHEYTGNLGGWVDKRVDSSGWVYLEAPPHDPANGYYG
YSVWSYCGVG**

FIGURE 12D

>CL00053062 (SEQ ID NO:98)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDEYIFVRNGDSRRPGLITY
INLSPNWVGRWVYVPNFAGACIHEYTGNLGGWVDKRVDSSGWVYLEAPPHDPANGYYGYS
VWSYCGVG**

>CL00053076 (SEQ ID NO:99)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTHEGQPVIFYRDFEEWLNKDKLINLIWIHDHLAGGSTTIVYYDNDELIFVRNGDSRRPGLIT
YINLSPNWVGRWVYVPKFAGACIHEYTGNLGGWVDKRVDSSGWVYLEAPPHDPANGYYGY
SVWSYCGVG**

>CL00053098 (SEQ ID NO:100)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKFTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGQTVVSRDPFKAVTFVANHDTDIIWNKYPAYAFIL
TYEGQPVIFYRDFEEWLNKDKLINLIWIHDHLAGGSTTIVYYDNDELIFVRNGDSRRPGLITYI
NLSPNWVGRWVYVPKFAGACIHEYTGNLGGWVDKRVDSSGWVYLEAPPHDPANGYYGYS
VWSYCGVG**

>CL00053179 (SEQ ID NO:101)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVKRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

FIGURE 12E

>CL00053182 (SEQ ID NO:102)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKFTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00053295 (SEQ ID NO:103)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKFTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTHEGQPVIFYRDFEEWLNKDKLINLIWIHDHLAGGSTTIVYYDNDELIFVRNGDSRRPGLIT
YINLSPNWVGRWVYVPKFAGACIHEYTGNLGGWVDKRVDSSGWVYLEAPPHDPANGYYGY
SVWSYCGVG**

>CL00053353 (SEQ ID NO:104)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKFTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVKRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00053441 (SEQ ID NO:105)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDYEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

FIGURE 12F

>CL00053513 (SEQ ID NO:106)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADIVINHRAGGDLEWNPFVGD
YTWTDFSKVASGKYTANYLDFHPNELHCCDEGTFGGFPDICHHKEWDQYWLWKSNESYAA
YLRSIGFDGWRFDYVKGYGAWVVRDWLNWWGGWAVGEYWDTNVDALLSWAYESGAKVF
DFPLYYKMDEAFDNNNIPALVYALQNGQTVVSRDPFKAVTFVANHDTDIIWNKYPAYAFIL
TYEGQPVIFYRDFEEWLNKDKLINLIWIHDHLAGGSTTIVYYDNDELIFVRNGDSRRPGLITYI
NLSPNWVGRWVYVPNFAGACIHEYTGNLGGWVDKRVDSSGWVYLEAPPHDPANGYYGYS
VWSYCGVG**

>CL00053515 (SEQ ID NO:107)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPNFAGACIHEYTGNLGGWVDKRVDSSGWVYLEAPPHDPANGYYGYS
VWSYCGVG**

>CL00053955 (SEQ ID NO:108)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRSGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTILYYDNDELIFVRNGDSRRPGLITY
INLSPNWVGRWVYVPKWAGACIHEYTGNLGGWVDKRVDSSGWVYLEAPPHDPANGYYGY
SVWSYCGVG**

>CL00054030 (SEQ ID NO:109)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFQAVTFVANHDTDIIWNKYPAYAF
ILTYEGQPVIFYRDFEEWLNKDKLINLIWIHDHLAGGSTTILYYDNDELIFVRNGDSRRPGLITY
INLSPNWVGRWVYVPKFAGACIHEYTGNSGGWVDKRVDSSGWVYLEAPPHDPANGYYGYS
VWSYCGVG**

FIGURE 12G

>CL00054048 (SEQ ID NO:110)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQNVVSRDPFKAVTFVANHDTDIIWNKYPAYAF
ILTYEGQPVIFYRDFEEWLNKDKLINLIWIHDHLAGGSTTILYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00054092 (SEQ ID NO:111)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRSGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

>CL00054095 (SEQ ID NO:112)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLADGSTTIVYYDNDELIFVRNGDSRRPGLITY
INLSPNWVGRWVYVPKWAGACIHEYTGNLGGWVDKRVDSSGWVYLEAPPHDPANGYYGY
SVWSYCGVG**

>CL00054107 (SEQ ID NO:113)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRSGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTILYYDNDELIFVRNGDSRRPGLITY
INLSPNWVGRWVYVPKFAGACIHEYTGNLGGWVDKRVDSSGWVYLEAPPHDPANGYYGYS
VWSYCGVG**

FIGURE 12H

>CL00054111 (SEQ ID NO:114)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKWAGACIHEYTGNSGGWVDKRVDSSGWVYLEAPPHDPANGYYGY
SVWSYCGVG**

>CL00054116 (SEQ ID NO:115)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQTVVSRDPFKAVTFVANHDTDIIWNKYPAYAF
ILTYEGQPVIFYRDFEEWLNKDKLINLIWIHDHLAGGSTTIVYYDNDELIFVRNGDSRRPGLITY
INLSPNWVGRWVYVPKFAGACIHEYTGNSGGWVDKRVDSSGWVYLEAPPHDPANGYYGYS
VWSYCGVG**

>CL00054126 (SEQ ID NO:116)
AKYLELEEGGVIMQAFYWDVPGGGIWWDHIRSKIPEWYEAGISAIWLPPPSKGMSGGYSMGY
DPYDYFDLGEYYQKGTVETRFGSKEELVRLIQTAHAYGIKVIADVVINHRAGGDLEWNPFVG
DYTWTDFSKVASGKYTANYLDFHPNELHCCDEGTFGGFPDICHHKEWDQYWLWKSNESYA
AYLRSIGFDGWRFDYVKGYGAWVVRDWLNWWGGWAVGEYWDTNVDALLSWAYESGAK
VFDFPLYYKMDEAFDNNNIPALVYALQNGQMVVSRDPFKAVTFVANHDTDIIWNKYPAYA
FILTYEGQPVIFYRDFEEWLNKDKLINLIWIHDHLAGGSTTIVYYDNDELIFVRNGDSRRPGLIT
YINLSPNWVGRWVYVPKFAGACIHEYTGNLGGWVDKRVDSSGWVYLEAPPHDPANGYYGY
SVWSYCGVG**

FIGURE 16A

| Colony Tracking Number | Activity and Acid Activity Improvement | Thermostability and Acid Tolerance Improvement | Activity, Thermoactivity and Acid Activity Improvement | AA Mutations w.r.t. G1P | Alias |
|---|---|---|---|---|---|
| | PF at pH4.6, 85°C, 3hrs | PF at pH4.6, 85°C, 3hrs after preincubation at pH4.6, 88°C for 10mins | PF at pH4.6, 95°C, 3hrs | | |
| CL00036023 | 1.00 | 1.00 | 1.00 | D165R | G2P |
| CL00037324 | 1.26 | 1.40 | 1.49 | D165R/N325A | |
| CL00037336 | 1.32 | 1.37 | 1.86 | D165R/N325L | |
| CL00037348 | 1.24 | 1.42 | 1.55 | D165R/N325G | |
| CL00037355 | 1.25 | 1.35 | 1.67 | D165R/N325C | |
| CL00037383 | 1.14 | 1.15 | 1.31 | P18T/D165R | |
| CL00037385 | 1.36 | 1.57 | 1.78 | D165R/N325K | |
| CL00037406 | 1.07 | 1.24 | 1.18 | D165R/A175N | |
| CL00037470 | 1.32 | 1.39 | 1.63 | D165R/N325S | |
| CL00037593 | 1.22 | 1.36 | 1.47 | D165R/N325T | |
| CL00037702 | 1.30 | 1.44 | 1.73 | D165R/N325R | G2V1 (G3P) |
| CL00037744 | 1.22 | 1.43 | 1.86 | D165R/N325M | |
| CL00037752 | 1.09 | 1.09 | 1.12 | D165R/S262R | |
| CL00037766 | 1.11 | 1.26 | 1.48 | D165R/N325F | |
| CL00037822 | 1.37 | 1.52 | 1.62 | D165R/N325H | |
| CL00038189 | 1.47 | 1.64 | 1.80 | D165R/N325P | |
| CL00038223 | 1.44 | 1.68 | 1.91 | P18T/D165R/N325L | |
| CL00038924 | 1.08 | 1.01 | 1.11 | G54F/D165R | |
| CL00039053 | 1.43 | 1.61 | 1.41 | G54N/D165R | |
| CL00039248 | 1.36 | 1.41 | 1.25 | D165R/D321T | |
| CL00039301 | 1.13 | 1.18 | 1.10 | D165R/Y377H | |
| CL00039390 | 1.37 | 1.44 | 1.30 | P18T/D165R/Y377C | |
| CL00039414 | 1.08 | 1.17 | 1.02 | G54S/D165R | |

FIGURE 16B

| Colony Tracking Number | Activity and Acid Activity Improvement | Thermostability and Acid Tolerance Improvement | Activity, Thermoactivity and Acid Activity Improvement | AA Mutations w.r.t. G1P | Alias |
|---|---|---|---|---|---|
| | PF at pH4.6, 85°C, 3hrs | PF at pH4.6, 85°C, 3hrs after preincubation at pH4.6, 96°C for 10mins | PF at pH4.6, 95°C, 3hrs | | |
| CL00037702 | 1.00 | 1.00 | 1.00 | D165R/N325R | G3P |
| CL00044971 | 1.24 | 1.15 | 1.36 | D165R/N325R/L393N/G395E | |
| CL00044986 | 1.26 | 1.34 | 1.44 | D165R/N325R/L393K | |
| CL00045052 | 1.18 | 1.14 | 1.28 | D165R/N325R/N392K/L393R | |
| CL00045079 | 1.23 | 1.37 | 1.17 | D165R/N325R/L393Q | |
| CL00045095 | 1.10 | 1.19 | 1.01 | D165R/N325R/A372S | |
| CL00045235 | 1.12 | 1.06 | 1.04 | D165R/N325R/A372P | |
| CL00045254 | 1.49 | 1.76 | 1.74 | D165R/N325R/L393P | |
| CL00045306 | 1.13 | 1.43 | 1.21 | A35V/D165R/N325R | |
| CL00045321 | 1.18 | 1.19 | 1.34 | D165R/N325R/L393S | |
| CL00045326 | 1.11 | 1.08 | 1.15 | D165R/N325R/L393A | |
| CL00045373 | 1.26 | 1.81 | 1.69 | D165R/N325R/L393E | |
| CL00045482 | 1.25 | 1.61 | 1.31 | D165R/N325R/S384T | |
| CL00045491 | 1.17 | 1.47 | 1.34 | D165R/N325R/L393R | |
| CL00045496 | 1.16 | 1.49 | 1.16 | D165R/V187I/N325R | |
| CL00045673 | 1.77 | 2.46 | 2.09 | T75S/D165R/N325R | |
| CL00045765 | 1.26 | 1.65 | 1.15 | D165R/V271M/N325R | |
| CL00046070 | 1.10 | 1.35 | 1.00 | D165R/N325R/V378C | |

FIGURE 16C

| Colony Tracking Number | Activity and Acid Activity Improvement | Thermostability and Acid Tolerance Improvement | Activity, Thermoactivity and Acid Activity Improvement | AA Mutations w.r.t. G1P | Alias |
|---|---|---|---|---|---|
| | PF at pH4.6, 85°C, 3hrs | PF at pH4.6, 85°C, 3hrs after preincubation at pH4.6, 96°C for 10mins | PF at pH4.6, 95°C, 3hrs | | |
| CL00046087 | 1.01 | 1.09 | 1.04 | D165R/A182W/N325R | |
| CL00046208 | 1.19 | 1.29 | 1.17 | D165R/V271S/N325R | |
| CL00046591 | 1.15 | 1.03 | 1.21 | D165R/N325R/V351T | |
| CL00046878 | 1.18 | 1.15 | 1.03 | D165R/I232K/N325R | |
| CL00046932 | 1.64 | 2.44 | 2.21 | P18T/D165R/A175N/N325R/Y377C | |
| CL00046960 | 1.44 | 1.99 | 1.70 | G54N/D165R/N325R/Y377Q | |
| CL00046965 | 1.31 | 1.87 | 1.72 | D165R/A175N/N325R | |
| CL00047034 | 1.35 | 1.98 | 1.55 | G54N/D165R/N325R/Y377H | |
| CL00047043 | 1.36 | 1.71 | 1.50 | P18T/G54N/D165R/N325R | |
| CL00047052 | 1.50 | 2.28 | 2.00 | G54N/D165R/N325R/Y377C | |
| CL00047056 | 1.57 | 2.13 | 2.09 | P18T/G54N/D165R/N325K/Y377Q | |
| CL00047106 | 1.23 | 1.52 | 1.32 | P18T/D165R/N325R/Y377C | |
| CL00047134 | 1.24 | 1.90 | 1.43 | P18T/G54N/D165R/D321T/N325R | |
| CL00047179 | 1.41 | 2.31 | 1.63 | G54N/D165R/A175N/N325R | |
| CL00047183 | 1.54 | 2.31 | 1.95 | D165R/A175N/N325H/Y377C | |
| CL00047186 | 1.38 | 1.65 | 1.40 | P18T/G54F/D165R/A175N/D321T/N325R/Y377C | |
| CL00047217 | 1.38 | 1.56 | 1.58 | P18T/D165R/A175N/N325R | |

FIGURE 16D

| Colony Tracking Number | Activity and Acid Activity Improvement | Thermostability and Acid Tolerance Improvement | Activity, Thermoactivity and Acid Activity Improvement | AA Mutations w.r.t. G1P | Alias |
|---|---|---|---|---|---|
| | PF at pH4.6, 85°C, 3hrs | PF at pH4.6, 85°C, 3hrs after preincubation at pH4.6, 96°C for 10mins | PF at pH4.6, 95°C, 3hrs | | |
| CL00047252 | 1.15 | 1.04 | 1.10 | D165R/N325R/Y377H | |
| CL00047281 | 1.50 | 1.73 | 1.86 | D165R/A175N/N325R/Y377C | |
| CL00047285 | 1.25 | 1.26 | 1.27 | G54F/D165R/A175N/N325R | |
| CL00047289 | 1.32 | 1.61 | 1.44 | G54F/D165R/A175N/D321T/N325L/Y377C | |
| CL00047307 | 1.34 | 1.85 | 1.69 | G54N/D165R/N325R | |
| CL00047348 | 1.32 | 1.65 | 1.46 | D165R/S262R/D321T/N325R/Y377H | |
| CL00047356 | 1.40 | 2.13 | 1.77 | G54N/D165R/N325L/Y377H | |
| CL00047406 | 1.20 | 1.12 | 1.17 | D165R/S262R/N325R | |

VARIANT AMYLASE ENZYME COMPOSITIONS AND METHODS

I. CROSS REFERENCE TO RELATED APPLICATIONS

This application claims priority to U.S. Provisional Patent Application No. 62/666,986, filed on May 4, 2018, which is expressly incorporated by reference in its entirety.

II. SEQUENCE LISTING

The instant application contains a Sequence Listing which has been submitted electronically in ASCII format and is hereby incorporated by reference in its entirety. Said ASCII copy, created on May 2, 2019, is named 114095-5007-US_ST25.txt and is 220 kilobytes in size.

III. FIELD OF THE INVENTION

This invention relates to variant amylases, polynucleotides encoding the variant amylases, methods of making the variant amylases, and methods of using the variant amylases. Also described are the use of amylases of the invention in various industries, such as starch processing, food, detergent, textile, paper and biofuel or drinking alcohol industries etc. The invention also relates to compositions comprising one or more variant amylases of the invention.

IV. BACKGROUND OF THE INVENTION

Starch is a polysaccharide composed of two types of polymers—amylose and amylopectin and is an important constituent of the human diet. Starch can be chemically and enzymatically processed into a variety of different products such as starch hydrolysates, glucose syrups, fructose, maltodextrin derivatives or cyclodextrins, used in food industry. The sugars produced can further be fermented to produce ethanol. In addition, starch contributes greatly to the textural properties of many foods, textiles and paper, and is therefore widely used in food, textiles and paper industries as a thickener, colloidal stabilizer, gelling agent, bulking agent, sizing agent and water retention agent.

Amylases are enzymes that catalyze the hydrolysis of starch molecules to yield dextrins and oligosaccharides. Amylases can be isolated from plants, animals or microorganisms. There are at least three types of amylases: α-amylases, β-amylases and γ-amylases. α-amylases is an enzyme of crucial importance due to its starch hydrolysis activity and and the activities that can be carried out owing to the hydrolysis. Specifically, α-amylases (E.C.3.2.1.1) are enzymes that catalyses the hydrolysis of internal α-1,4-glycosidic linkages in starch to yield products, such as glucose, maltose and maltotriose units. Amylases, especially, α-amylases have a wide range of applications, such as in starch conversion, food/bakery, detergent, textile, paper, biofuel or drinking alcohol industries etc. Many of the industrial processes that utilize amylases are run under generally harsh conditions such as low/high pH, high temperature etc.

Therefore, there remains a need in the art for variant amylases with increased activity, thermoactivity, thermostability, acid activity, acid tolerance and pH stability. The present invention meets this need and provides variant amylases with improved characteristics compared to parent amylase(s). Such improved amylases have wide applications in production of fructose and glucose, food/bakery, detergent, textile, paper and biofuel or drinking alcohol industries.

It is an object of the present invention to provide variant amylase enzymes having amylase activity with improved properties as compared to the parent amylases, and polynucleotides encoding the variant amylase enzymes as well as methods of making and using such variant amylase enzymes in various processes.

V. BRIEF SUMMARY OF THE INVENTION

Accordingly, the present invention provides variant amylases and methods of making and using them. In some embodiments, the invention provides compositions comprising variant amylase enzymes comprising at least one amino acid substitution as compared to SEQ ID NO:1, wherein the variant enzyme has amylases activity, and wherein the amino acid substitution is at a position number selected from the group consisting of 18, 19, 22, 35, 54, 71, 75, 130, 165, 175, 182, 187, 232, 233, 262, 266, 271, 321, 325, 351, 372, 377, 378, 384, 392, 393, 394, 395, 417 and 420.

In one aspect, the invention provides compositions comprising a variant amylase enzyme comprising at least one amino acid substitution as compared to SEQ ID NO:1, wherein said variant enzyme has amylase activity, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, and wherein said variant amylase enzyme exhibits at least 95% identity to SEQ ID NO:1.

In an additional aspect, the invention provides compositions comprising a variant amylase enzyme comprising at least one amino acid substitution as compared to SEQ ID NO:1, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, wherein said variant amylase enzyme exhibits at least 95% identity to SEQ ID NO:1, and wherein said variant enzyme has at least 1.1 fold better amylase activity as compared to SEQ ID NO:1 under a condition selected from the group consisting of thermostability at 70° C., thermostability at 75° C., thermostability at 80° C., thermostability at 85° C., thermostability at 90° C., thermostability at 95° C., and thermostability at 100° C.

In an additional aspect, the invention provides compositions comprising a variant amylase enzyme comprising at least one amino acid substitution as compared to SEQ ID NO:1, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, wherein said variant amylase enzyme exhibits at least 95% identity to SEQ ID NO:1, and wherein said variant enzyme has at least 1.1 fold better amylase activity as compared to SEQ ID NO:1 under a condition of pH at 4.6 or pH at 6.

In an additional aspect, the invention provides compositions comprising a variant amylase enzyme comprising at least one amino acid substitution as compared to SEQ ID NO:1 as described herein, wherein said variant amylase enzymes exhibit at least at least 98% identity to SEQ ID NO:1.

In a further aspect, the invention provides compositions comprising a variant amylase enzyme comprising at least one amino acid substitution as compared to SEQ ID NO:1 as described herein, wherein said variant amylase enzyme has one of said amino acid substitution, two of said amino acid substitutions, three of said amino acid substitutions, four of said amino acid substitutions, five of said amino acid substitutions, six of said amino acid substitutions, or seven of said amino acid substitutions.

In an additional aspect, the invention provides compositions comprising a variant amylase enzyme comprising at least one amino acid substitution as compared to SEQ ID NO:1 as described herein, wherein said amino acid substitution(s) is selected from the group consisting of: E19A, N266T, R233H, N266C, A417G, E19D, Y420T, N325Y, Y420L, Y71W, N325V, G394N, G394T, N325F, K130R, N325T, G394P, N325R, I22A, D165N, D165R, D165R/N325A, D165R/N325L, D165R/N325G, D165R/N325C, P18T/D165R, D165R/N325K, D165R/A175N, D165R/N325S, D165R/N325T, D165R/N325R, D165R/N325M, D165R/S262R, D165R/N325F, D165R/N325H, D165R/N325P, P18T/D165R/N325L, G54F/D165R, G54N/D165R, D165R/D321T, D165R/Y377H, P18T/D165R/Y377C, G54S/D165R, D165R/N325R/L393N/G395E, D165R/N325R/L393K, D165R/N325R/N392K/L393R, D165R/N325R/L393Q, D165R/N325R/A372S, D165R/N325R/A372P, D165R/N325R/L393P, A35V/D165R/N325R, D165R/N325R/L393S, D165R/N325R/L393A, D165R/N325R/L393E, D165R/N325R/S384T, D165R/N325R/L393R, D165R/V187I/N325R, T75S/D165R/N325R, D165R/V271M/N325R, D165R/N325R/V378C, D165R/A182W/N325R, D165R/V271S/N325R, D165R/N325R/V351T, D165R/I232K/N325R, P18T/D165R/A175N/N325R/Y377C, G54N/D165R/N325R/Y377Q, D165R/A175N/N325R, G54N/D165R/N325R/Y377H, P18T/G54N/D165R/N325R, G54N/D165R/N325R/Y377C, P18T/G54N/D165R/N325K/Y377Q, P18T/D165R/N325R/Y377C, P18T/G54N/D165R/D321T/N325R, G54N/D165R/A175N/N325R, D165R/A175N/N325H/Y377C, P18T/G54F/D165R/A175N/D321T/N325R/Y377C, P18T/D165R/A175N/N325R, D165R/N325R/Y377H, D165R/A175N/N325R/Y377C, G54F/D165R/A175N/N325R, G54F/D165R/A175N/D321T/N325L/Y377C, G54N/D165R/N325R, D165R/S262R/D321T/N325R/Y377H, G54N/D165R/N325L/Y377H, and D165R/S262R/N325R.

In a further aspect, the invention provides compositions comprising a variant amylase enzyme comprising at least one amino acid substitution as compared to SEQ ID NO:1 as described herein, wherein said amino acid substitution(s) is selected from the group consisting of: Y420T, N325R, I22A, D165N, D165R, and D165R/N325R.

In another aspect, the invention provides compositions comprising a variant amylase enzyme comprising at least one amino acid substitution as compared to SEQ ID NO:1 as described herein, wherein said amino acid substitution comprises Y420T, and wherein said variant amylase enzyme exhibits at least 90% identity to SEQ ID NO:8.

In an additional aspect, the invention provides a variant amylase enzyme having an amino acid sequence of SEQ ID NO:8.

In another aspect, the invention provides compositions comprising a variant amylase enzyme comprising at least one amino acid substitution as compared to SEQ ID NO:1 as described herein, wherein said amino acid substitution comprises N325R, and wherein said variant amylase enzyme exhibits at least 90% identity to SEQ ID NO:5.

In an additional aspect, the invention provides a variant amylase enzyme having an amino acid sequence of SEQ ID NO:5.

In another aspect, the invention provides compositions comprising a variant amylase enzyme comprising at least one amino acid substitution as compared to SEQ ID NO:1 as described herein, wherein said amino acid substitution comprises I22A, and wherein said variant amylase enzyme exhibits at least 90% identity to SEQ ID NO:7.

In an additional aspect, the invention provides a variant amylase enzyme having an amino acid sequence of SEQ ID NO:7.

In another aspect, the invention provides compositions comprising a variant amylase enzyme comprising at least one amino acid substitution as compared to SEQ ID NO:1 as described herein, wherein said amino acid substitution comprises D165N, and wherein said variant amylase enzyme exhibits at least 90% identity to SEQ ID NO:6.

In an additional aspect, the invention provides a variant amylase enzyme having an amino acid sequence of SEQ ID NO:6.

In another aspect, the invention provides compositions comprising a variant amylase enzyme comprising at least one amino acid substitution as compared to SEQ ID NO:1 as described herein, wherein said amino acid substitution comprises D165R, and wherein said variant amylase enzyme exhibits at least 90% identity to SEQ ID NO:2.

In an additional aspect, the invention provides a variant amylase enzyme having an amino acid sequence of SEQ ID NO:2.

In another aspect, the invention provides compositions comprising a variant amylase enzyme comprising at least one amino acid substitution as compared to SEQ ID NO:1 as described herein, wherein said amino acid substitutions comprise D165R/N325R, and wherein said variant amylase enzyme exhibits at least 90% identity to SEQ ID NO:3.

In an additional aspect, the invention provides a variant amylase enzyme having an amino acid sequence of SEQ ID NO:3.

In some embodiments, the invention provides compositions comprising variant amylase enzymes comprising at least one amino acid substitution as compared to SEQ ID NO:4, wherein the variant enzyme has amylases activity, and wherein the amino acid substitution is at a position number selected from the group consisting of 19, 67, 83, 107, 113, 139, 271, 272, 275, 280, 306, 317, 338, 344, 351, 383, 384, and 396.

In one aspect, the invention provides compositions comprising a variant amylase enzyme comprising at least one amino acid substitution as compared to SEQ ID NO:4, wherein said variant enzyme has amylase activity, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S; and wherein said variant amylase enzyme exhibits at least 95% identity to SEQ ID NO:4.

In an additional aspect, the invention provides compositions comprising a variant amylase enzyme comprising at least one amino acid substitution as compared to SEQ ID NO:4, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme exhibits at least 95% identity to SEQ ID NO:4, and wherein said variant enzyme has at least 1.1 fold better amylase activity as compared to SEQ ID NO:4 under a condition of thermostability at 70° C. or thermostability at 100° C.

In an additional aspect, the invention provides compositions comprising a variant amylase enzyme comprising at least one amino acid substitution as compared to SEQ ID NO:4, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme exhibits at least 95% identity to SEQ ID NO:4, and wherein said variant enzyme has at least 1.1 fold better amylase activity as compared to SEQ ID NO:4 under a condition of pH at 4.6 or pH at 6.

In an additional aspect, the invention provides compositions comprising a variant amylase enzyme comprising at least one amino acid substitution as compared to SEQ ID NO:4 as described herein, wherein said variant amylase enzymes exhibit at least at least 98% identity to SEQ ID NO:4.

In a further aspect, the invention provides compositions comprising a variant amylase enzyme comprising at least one amino acid substitution as compared to SEQ ID NO:4 as described herein, wherein said variant amylase enzyme has one of said amino acid substitution, two of said amino acid substitutions, three of said amino acid substitutions, four of said amino acid substitutions, five of said amino acid substitutions, six of said amino acid substitutions, or seven of said amino acid substitutions.

In an additional aspect, the invention provides compositions comprising a variant amylase enzyme comprising at least one amino acid substitution as compared to SEQ ID NO:4 as described herein, wherein said amino acid substitution(s) is selected from the group consisting of: Y67L, D19K, F83L, V107I/Q271D/F317Y/K383N, S275K/K383N, Y139F/K383N, V107I/Y306H/K383N, V107I/Y139F/Q271D/K383N, V107I/Y306H, V107I, Y306H/K383N, L351Y/K383N, Y306H, V107I/Y139F, S275K, Y139F, Y139F/Y306H, Y139F/S275K, F317Y, V107I/K383N, K383N, A113S/V344L/F384W, K280Q/V344L/L396S, T272N/V344L, A113S, G338D/F384W, A113S/V344L, F384W/L396S, L396S and T272M.

In an additional aspect, the invention provides compositions comprising a variant amylase enzyme comprising at least one amino acid substitution as compared to SEQ ID NO:4 as described herein, wherein said amino acid substitution(s) is D19K or V107I/Y306H/K383N.

In another aspect, the invention provides compositions comprising a variant amylase enzyme comprising at least one amino acid substitution as compared to SEQ ID NO:4 as described herein, wherein said amino acid substitution comprises D19K, and wherein said variant amylase enzyme exhibits at least 90% identity to SEQ ID NO:10.

In an additional aspect, the invention provides a variant amylase enzyme having an amino acid sequence of SEQ ID NO:10.

In another aspect, the invention provides compositions comprising a variant amylase enzyme comprising at least one amino acid substitution as compared to SEQ ID NO:4 as described herein, wherein said amino acid substitutions are V107I/Y306H/K383N, and wherein said variant amylase enzyme exhibits at least 90% identity to SEQ ID NO:9.

In an additional aspect, the invention provides a variant amylase enzyme having an amino acid sequence of SEQ ID NO:9.

In an additional aspect, the invention provides methods of making variant amylase enzyme(s) comprising substituting one or more amino acids of a parent amylase enzyme of SEQ ID NO:1, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, wherein said variant amylase enzyme has amylase activity, and wherein said variant amylase enzyme exhibits at least 95% identity to SEQ ID NO:1.

In an additional aspect, the invention provides methods of making variant amylase enzyme(s) comprising substituting one or more amino acids of a parent amylase enzyme of SEQ ID NO:4, wherein said amino acid substitution is selected from the group consisting of: wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme has amylase activity, and wherein said variant amylase enzyme exhibits at least 95% identity to SEQ ID NO:4.

In a further aspect, the invention provides nucleic acids encoding variant amylase enzymes as described herein.

In an additional aspect, the invention provides nucleic acids encoding variant amylase enzymes as described herein, wherein the nucleic acid is codon optimized for a host organism for expression of the variant amylase enzyme in said organism.

In a further aspect, the invention provides expression vectors comprising nucleic acids as described herein.

In a further aspect, the invention provides host cells comprising the nucleic acids as described herein.

In an additional aspect, the invention provides host cells comprising the expression vectors as described herein.

In a further aspect, the invention provides host cells that are selected from the group consisting of a bacterial cell, a fungal cell, or a yeast cell.

In an additional aspect, the invention provides methods of making variant amylase enzymes comprising: a) culturing a host cell comprising a nucleic acid expressing said variant amylase enzyme as described herein under conditions wherein the variant amylase enzyme is expressed; and b) purifying the variant amylase enzyme.

In a further aspect, the invention provides methods of converting starch in industries of fructose and glucose production, bakery, detergent, textile, paper and/or biofuel alcohol comprises contacting said starch with said variant amylase as described herein.

In further aspects, the invention provides methods of using variant amylase enzymes as described above in industries of fructose and glucose production, bakery, detergent, textile, paper and/or biofuel alcohol.

VI. BRIEF DESCRIPTION OF THE DRAWINGS

FIG. 1A provides data regarding temperature profile of Pp.Amy and Pf.Amy at pH 6.0. FIG. 1B provides data regarding temperature profile of Pp.Amy and Pf.Amy at pH 4.6.

FIG. 2 provides a schematic of the domains of amylases: Pp.Amy (SEQ ID NO:1) and Pf.Amy (SEQ ID NO:4). The Pre region (signal peptide) is bolded and underlined, followed by the mature region, which is neither bolded nor underlined. Full length sequence alignment demonstrates that Pp.Amy and Pf.Amy are 79% identical at the full length (Pre-Mature) and 82% identical at the mature region.

FIG. 3 provides data regarding activity improvement, thermostability and acid tolerance improvement as well as activity, thermoactivity and acid activity improvement of variant amylases as compared to Pp.Amy G1P (SEQ ID NO:1; Colony Tracking Number: CL00026174). Sequence numbering starts from the mature region.

FIG. 4 provides data regarding activity and acid activity improvement, thermostability and acid tolerance improvement as well as activity, thermoactivity and acid activity improvement of variant amylases as compared to Pp.Amy G2P (SEQ ID NO:2; Colony Tracking Number: CL00036023). Sequence numbering starts from the mature region.

FIG. 5A and FIG. 5B provides data regarding activity and acid activity improvement, thermostability and acid tolerance improvement as well as activity, thermoactivity and acid activity improvement of variant amylases as compared to Pp.Amy G3P (SEQ ID NO:3; Colony Tracking Number: CL00037702). Sequence numbering starts from the mature region.

FIG. 6A and FIG. 6B provides data regarding activity improvement, thermostability improvement, thermoactivity improvement as well as activity, thermoactivity and acid activity improvement of variant amylases as compared to Pf.Amy G1P (SEQ ID NO:4; Colony Tracking Number: CL00049011). Sequence numbering starts from the mature region.

FIG. 7 depict a variant table showing beneficial mutations of Pp.Amy at various positions. Sequence numbering starts from the mature region. As described herein, these may be combined in any combination, and with variant sets as outlined herein.

FIG. 8 depict a variant table showing beneficial mutations of Pf.Amy at various positions. Sequence numbering starts from the mature region. As described herein, these may be combined in any combination, and with variant sets as outlined herein.

FIG. 9 shows closest homologs to Pp.Amy.

FIG. 10 shows closest homologs to Pf.Amy.

Figure 1A:
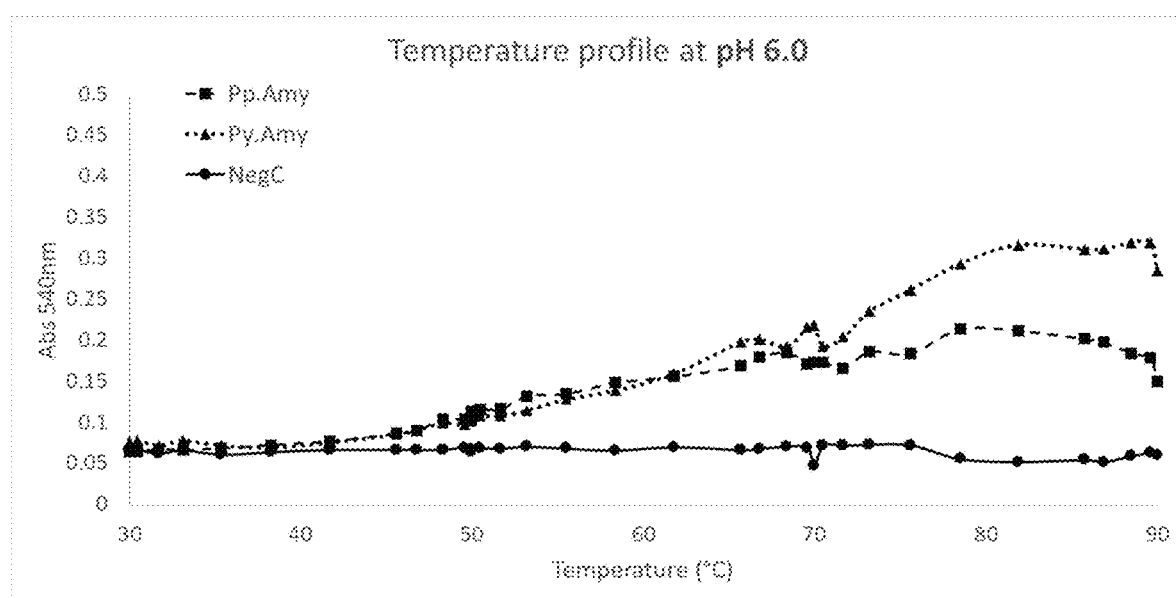

FIGS. 11A-11V show the amino acid sequences of the mature region of Pp.Amy G1P (Colony Tracking number: CL00026174, SEQ ID NO:1) and variant amylases. FIG. 11A shows the amino acid sequences of the mature region of Pp.Amy G1P (Colony tracking number: CL00026174, SEQ ID NO:1) and variant amylases: CL00034838, CL00034918, and CL00034919. FIG. 11B shows the amino acid sequences of the mature region of Pp.Amy variant amylases: CL00034933, CL00034936, CL00034950, and CL00035000 Pp.Amy G1V5 (SEQ ID NO:8). FIG. 11C shows the amino acid sequences of the mature region of Pp.Amy variant amylases: CL00035021, CL00035092, CL00035110, and CL00035119. FIG. 11D shows the amino acid sequences of the mature region of Pp.Amy variant amylases: CL00035153, CL00035195, CL00035200, and CL00035271. FIG. 11E shows the amino acid sequences of the mature region of Pp.Amy variant amylases: CL00035301, CL00035364, CL00035374 Pp.Amy G1V2 (SEQ ID NO:5), and CL00035764 Pp.Amy G1V4 (SEQ ID NO:7). FIG. 11F shows the amino acid sequences of the mature region of Pp.Amy variant amylases: CL00035771 Pp.Amy G1V3 (SEQ ID NO:6), CL00036023 Pp.Amy G1V1 (G2P) (SEQ ID NO:2), CL00037324, and CL00037336. FIG. 11G shows the amino acid sequences of the mature region of Pp.Amy variant amylases: CL00037348, CL00037355, CL00037383, and CL00037385. FIG. 11H shows the amino acid sequences of the mature region of Pp.Amy variant amylases: CL00037406, CL00037470, CL00037593, and CL00037702 Pp.Amy G2V1 (G3P) (SEQ ID NO:3). FIG. 11I shows the amino acid sequences of the mature region of Pp.Amy variant amylases: CL00037744, CL00037752, CL00037766, and CL00037822. FIG. 11J shows the amino acid sequences of the mature region of Pp.Amy variant amylases: CL00038189, CL00038223, CL00038924, and CL00039053. FIG. 11K shows the amino acid sequences of the mature region of Pp.Amy variant amylases: CL00039248, CL00039301, CL00039390, and CL00039414. FIG. 11L shows the amino acid sequences of the mature region of Pp.Amy variant amylases: CL00044971, CL00044986, CL00045052 and CL00045079. FIG. 11M shows the amino acid sequences of the mature region of Pp.Amy variant amylases: CL00045095, CL00045235, CL00045254, and CL00045306. FIG. 11N shows the amino acid sequences of the mature region of Pp.Amy variant amylases: CL00045321, CL00045326, CL00045373, and CL00045482. FIG. 11O shows the amino acid sequences of the mature region of Pp.Amy variant amylases: CL00045491, CL00045496, CL00045673, and CL00045765. FIG. 11P shows the amino acid sequences of the mature region of Pp.Amy variant amylases: CL00046070, CL00046087, CL00046208, and CL00046591. FIG. 11Q shows the amino acid sequences of the mature region of Pp.Amy variant amylases: CL00046878, CL00046932, CL00046960, and CL00046965. FIG. 11R shows the amino acid sequences of the mature region of Pp.Amy variant amylases: CL00047034, CL00047043, CL00047052, and CL00047056. FIG. 11S shows the amino acid sequences of the mature region of Pp.Amy variant amylases: CL00047106, CL00047134, CL00047179, and CL00047183. FIG. 11T shows the amino acid sequences of the mature region of Pp.Amy variant amylases: CL00047186, CL00047217, CL00047252 and CL00047281. FIG. 11U shows the amino acid sequences of the mature region of Pp.Amy variant amylases: CL00047285, CL00047289, CL00047307, and CL00047348. FIG. 11V shows the amino acid sequences of the mature region of Pp.Amy variant amylases: CL00047356 and CL00047406.

FIGS. 12A-12H show the amino acid sequences of the mature region of Pf.Amy G1P (Colony Tracking number: CL00049011, SEQ ID NO:4) and variant amylases. FIG.

12A shows the amino acid sequences of the mature region of Pf.Amy G1P (Colony Tracking number: CL00049011, SEQ ID NO:4) and variant amylases: CL00050734, CL00050960 Pf.Amy G1V2 (SEQ ID NO:10), and CL00051180. FIG. 12B shows the amino acid sequences of the mature region of Pf.Amy variant amylases: CL00052897, CL00052900, CL00052961, and CL00052982 Pf.Amy G1V1 (SEQ ID NO:9). FIG. 12C shows the amino acid sequences of the mature region of Pf.Amy variant amylases: CL00053009, CL00053023, CL00053036, and CL00053038. FIG. 12D shows the amino acid sequences of the mature region of Pf.Amy variant amylases: CL00053062, CL00053076, CL00053098, and CL00053179. FIG. 12E shows the amino acid sequences of the mature region of Pf.Amy variant amylases: CL00053182, CL00053295, CL00053353, and CL00053441. FIG. 12F shows the amino acid sequences of the mature region of Pf.Amy variant amylases: CL00053513, CL00053515, CL00053955, and CL00054030. FIG. 12G shows the amino acid sequences of the mature region of Pf.Amy variant amylases: CL00054048, CL00054092, CL00054095, and CL00054107. FIG. 12H shows the amino acid sequences of the mature region of Pf.Amy variant amylases: CL00054111, CL00054116, and CL00054126.

Figure 13A:
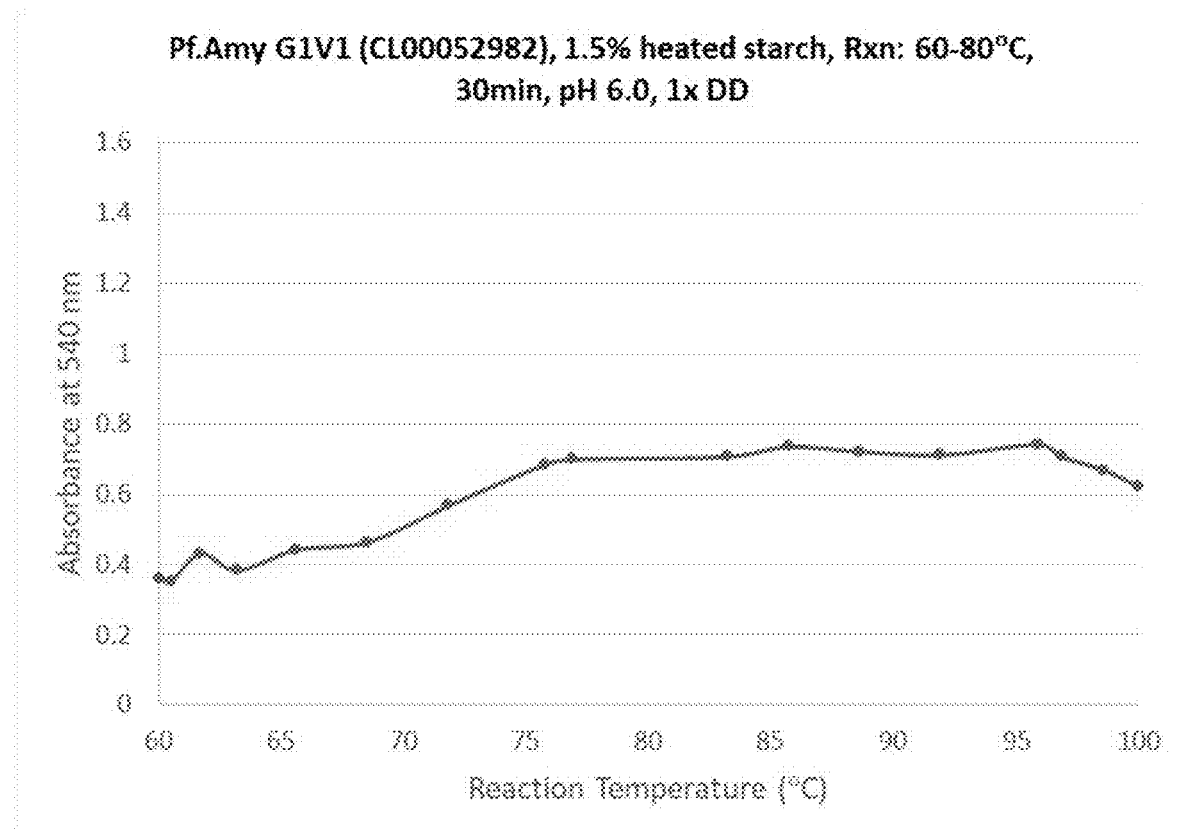
Figure 13B:
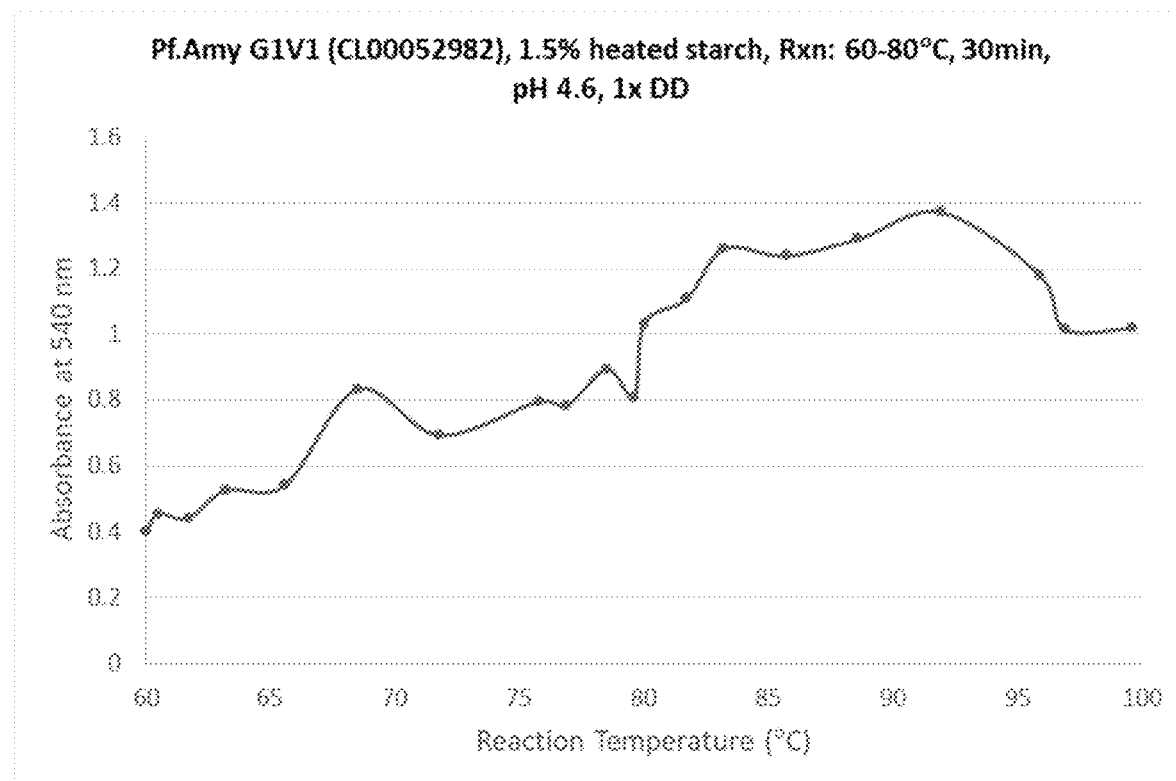

FIGS. 13A-13B provide data regarding temperature profile of Pf.Amy G1V1 produced by *Pichia pastoris* at pH 6.0 (FIG. 13A) and pH 4.6 (FIG. 13B).

Figure 14:
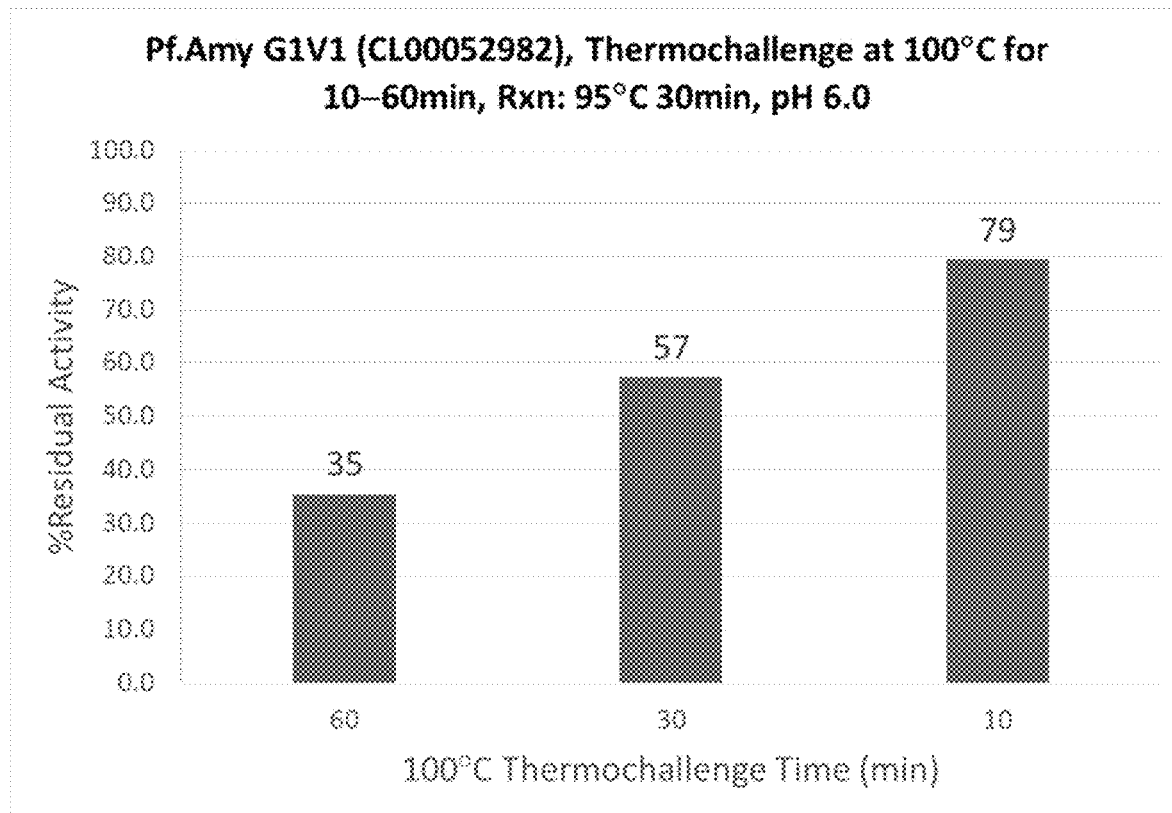

FIG. 14 provides data regarding thermostability of Pf.Amy G1V1 produced by *Pichia pastoris* at pH 6.0.

Figure 15:
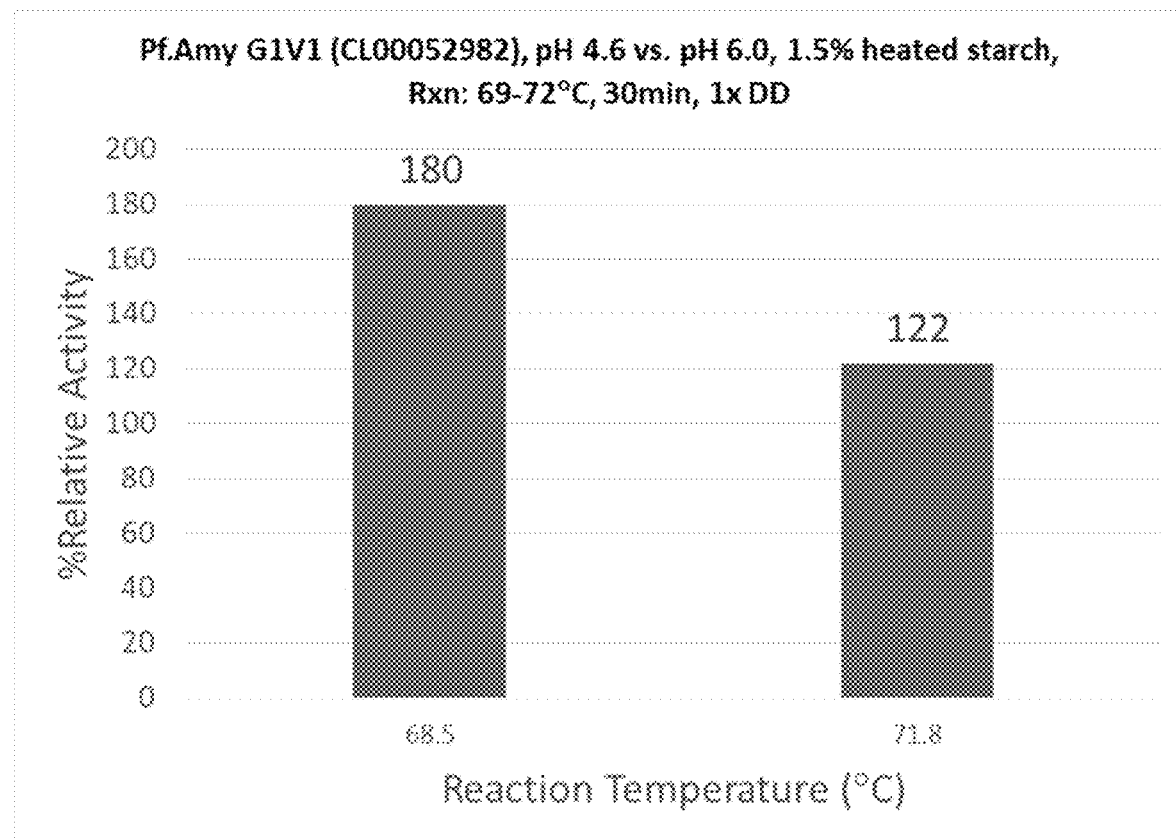

FIG. 15 provides data regarding pH stability of Pf.Amy G1V1 produced by *Pichia pastoris* at around 70° C.

FIG. 16A, FIG. 16B, FIG. 16C and FIG. 16D provide data regarding activity improvement, thermostability and acid tolerance improvement as well as activity, thermoactivity and acid activity improvement of variant amylases as compared to Pp.Amy G1P (SEQ ID NO:1; Colony Tracking Number: CL00026174). Sequence numbering starts from the mature region.

VII. DETAILED DESCRIPTION OF THE INVENTION

A. Introduction

Starch is a polysaccharide composed of two types of polymers—amylose and amylopectin. Amylases are enzymes that catalyze the hydrolysis of starch molecules to yield dextrins and oligosaccharides. Amylases can be isolated from plants, animals or microorganisms. There are at least three types of amylases: α-amylases, γ-amylases and γ-amylases. α-amylase (E.C.3.2.1.1) is a hydrolase enzyme that catalyses the hydrolysis of internal α-1,4-glycosidic linkages in starch to yield products like glucose and maltose. β-amylase (EC 3.2.1.2) is an exo-hydrolase enzyme that acts from the nonreducing end of a polysaccharide chain by hydrolysis of α-1,4-glucan linkages to yield successive maltose units. γ-amylase (EC 3.2.1.3) cleaves α(1-6)glycosidic linkages, in addition to cleaving the last α(1-4)glycosidic linkages at the nonreducing end of amylose and amylopectin, unlike the other forms of amylase, yielding glucose.

Amylase enzymes have a wide range of applications, such as in starch processing, food/bakery, detergent, textile, paper, biofuel or drinking alcohol industries etc. α-Amylase has become an enzyme of crucial importance due to its starch hydrolysis activity and the activities that can be carried out owing to the hydrolysis. One such activity is the production of glucose and fructose syrup from starch. After gelatinization, α-Amylase catalyses the first step in this process called liquefaction to partically hydrolyze starch into short chain dextrins resulting in reduction of the viscosity of the starch suspension. Saccharification is the production of glucose and fructose syrup via further hydrolysis by glucoamylase.

Many of the industrial processes that utilize amylases are run under generally harsh conditions such as low/high pH, high temperature etc. The present invention provides variant amylases with improved properties compared to parent amylases, and such variant amylases can be used in wide applications, such as, in starch processing, food/bakery, detergent, textile, paper, biofuel or drinking alcohol industries etc.

B. Definitions

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E19A refers to a variant polypeptide, in this case an amylase, in which the glutamic acid at position 19 (sequence numbering starts from the mature position) is replaced with alanine. Multiple mutations are separated by forward slash marks ("/"), e.g., "K18R/A58G/N246G" representing substitutions at positions 18, 58 and 246, respectively. For clarity, a protein which has been engineered to change the nucleic acid coding sequence but not change the starting amino acid (for example, exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233#, E233( ) or E233del designates a deletion of glutamic acid at position 233. Additionally, EDA233– or EDA233# designates a deletion of the sequence GluAspAla that begins at position 233.

By "parent polypeptide/protein" or "parental polypeptide/protein" as used herein is meant a starting polypeptide/protein that is subsequently modified to generate a variant.

The parent polypeptide/protein may be a naturally occurring polypeptide/protein, or a variant or engineered version of a naturally occurring polypeptide/protein. Parent polypeptide/protein may refer to the polypeptide/protein itself, compositions that comprise the parent polypeptide/protein, or the amino acid sequence that encodes it. In the present case, some embodiments utilize G1P, G2P or G3P as parent polypeptides/proteins.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about 20 amino acid modifications, and preferably from about one to about six amino acid modifications compared to the parent. As described below, in some embodiments the parent polypeptide is a wild type sequence, designated "G1P" herein. As further discussed below, the protein variant sequence herein will preferably possess at least about 80% identity with a parent protein sequence, and most preferably at least about 90% identity, more preferably at least about 95-96-97-98-99% identity. Variant protein can refer to the variant protein itself, compositions comprising the protein variant, or the DNA sequence that encodes it. Thus, by "variant amylase" herein is meant a novel amylase that has at least one amino acid modification in the amino acid sequence as compared to a parent amylase enzyme. As discussed herein, in some cases the parent amylase is a second or higher generation of variant. Unless otherwise noted or as will be obvious from the context, the variant amylases of the invention generally are compared to the wild type G1P sequence, G2P sequence or G3P sequence. Additionally, unless otherwise noted, the variant amylases of the invention are enzymatically active, that is, there is detectable amylase activity using assay(s) in the art, such as, an amylase assay-Dinitrosalicyclic Acid Method (DNS), iodine assay, Megazyme Ceralpha kit, Nelson-Somogyi (NS) method, and methods to determine reduction in viscosity of starch suspension (e.g. falling number, Amylograph/Farinograph Test).

As used herein, "protein" herein is meant at least two covalently attached amino acids, which includes proteins, polypeptides, oligopeptides and peptides. The peptidyl group generally comprise naturally occurring amino acids and peptide bonds. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Glycine 50 (also referred to as G50 or Gly50) is a residue at position 50 in the G1P parental enzyme.

By "non-naturally occurring modification" as used herein is meant an amino acid modification that is not found in the wild type parent (e.g. G1P) enzyme.

By "amino acid" and "amino acid identity" as used herein is meant one of the 20 naturally occurring amino acids that are coded for by DNA and RNA.

By "position" as used herein is meant a location in the sequence of a protein. In general, the position number (which is more fully discussed below) is relative to the first amino acid of the mature amylase sequence, e.g. excluding the signal peptide.

The term "Amylases" as used herein are enzymes that catalyze the hydrolysis of starch molecules to yield dextrins and oligosaccharides. Amylases can be isolated from plants, animals or microorganisms. There are at least three types of amylases: α-amylases, β-amylases and γ-amylases. For purposes of the present invention, amylase activity is determined according to the procedures described in the Examples herein, for example, the DNS assay.

The term "coding sequence" refers to a polynucleotide, which directly specifies the amino acid sequence of a variant. The boundaries of the coding sequence are generally determined by an open reading frame, which begins with a start codon such as ATG, GTG or TTG and ends with a stop codon such as TAA, TAG, or TGA. The coding sequence may be a genomic DNA, cDNA, synthetic DNA, or a combination thereof.

The term "control sequences" means nucleic acid sequences necessary for expression of a polynucleotide encoding a variant of the present invention. Each control sequence may be native (i.e., from the same gene) or foreign (i.e., from a different gene) to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a variant.

The term "expression" includes any step involved in the production of a variant amylase described herein, including, but not limited to, transcription, post-transcriptional modification, translation, post-translational modification, and secretion.

The term "expression vector" refers to a linear or circular DNA molecule that comprises a polynucleotide encoding a variant and is operably linked to control sequences that provide for its expression.

The term "fragment" means a polypeptide having one or more (e.g., several) amino acids absent from the amino and/or carboxyl terminus of a mature polypeptide. A "amylase fragment" herein means a portion of an amino acid sequence depicted herein that maintains amylase activity. In one aspect, a fragment contains at least 250, at least 300, at least 350, at least 400 or at least 430 amino acid residues amino acid residues. In some embodiments, the fragment is at least 420, at least 425 or at least 430 amino acid residues. In some embodiments, the fragment is at least 422, at least 423, at least 424, at least 425, at least 426, at least 427, at least 428, at least 429, at least 430, or at least 431 amino acid residues. In some embodiments, the fragment is at least 425, at least 426, at least 427, at least 428, at least 429, at least 430, or at least 431, at least 432, at least 433 or at least 424 amino acid residues.

The term "host cell" refers to any cell type that is susceptible to transformation, transfection, transduction, or the like with a nucleic acid construct or expression vector comprising a polynucleotide of the present invention, and that allows for expression of the enzyme. The term "host cell" encompasses any progeny of a parent cell that is not identical to the parent cell due to mutations that occur during replication.

By "improved" herein is meant a desirable change of at least one biochemical property. "Improved function" can be measured as a percentage increase or decrease of a particular activity, or as a "fold" change, with increases of desirable properties (e.g. pH stability, thermostability, thermoactivity, acid tolerance, acid activity etc.) or decreases of undesirable properties (e.g. protease sensitivity, calcium dependence). That is, a variant may have a 10% increase in thermostability or a 10% decrease in protease sensitivity or calcium dependence, as compared to a parent amylase. Alternatively, a variant amylase may have a 2-fold increase in pH stability or a 3-fold decrease in protease sensitivity or calcium dependence. In general, percentage changes are used to describe changes in biochemical activity of less than 100%, and fold-changes are used to describe changes in biochemical activity of greater than 100% (as compared to the parental enzyme). In the present invention, percentage changes (usually increases) of biochemical activity of at least about 10%, 20%, 30%, 40%, 50%, 60%, 70%, 80%, 90%, 95%, 98% and 99% can be accomplished. In the present invention, a "fold increase" (or decrease) is measured as compared to the starting or parent enzyme. For example, as shown in the FIG. 3, G1V3 has a 5.22 fold increase in activity improvement as compared to G1P: this is calculated by [(activity of variant)/(activity of parent)]. In many embodiments, the improvement is at least one and a tenth fold (1.1), one and a half fold (1.5 fold), 2 fold, 3 fold, 4 fold, 5 fold, 6 fold, 7 fold, 8 fold, 9 fold, or 10 fold or higher.

The term "isolated" refers to a substance in a form or environment which does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., multiple copies of a gene encoding the substance; use of a stronger promoter than the promoter naturally associated with the gene encoding the substance).

The term "mature polypeptide" means a polypeptide in its final form following translation and any post-translational modifications, such as N-terminal processing, C-terminal truncation, glycosylation, phosphorylation, etc.

The phrase "mature polypeptide coding sequence" refers to a polynucleotide that encodes a mature polypeptide having amylase activity.

The term "nucleic acid construct" refers to a nucleic acid molecule, either single-stranded or double-stranded, which is isolated from a naturally occurring gene or is modified to contain segments of nucleic acids in a manner that would not otherwise exist in nature or which is synthetic, and which comprises one or more control sequences.

The term "operably linked" refers to a configuration in which a control sequence is placed at an appropriate position relative to the coding sequence of a polynucleotide such that the control sequence directs expression of the coding sequence.

The term "parent" or "parent amylase" refers to an amylase to which an alteration is made to produce the variant amylase of the present invention. The parent may be a naturally occurring (wild-type) polypeptide or a variant or fragment thereof. An exemplary parent polypeptide of the present invention is SEQ ID NO:1, SEQ ID NO:2, SEQ ID NO:3 or SEQ ID NO:4.

The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, J. Mol. Biol. 48: 443-453) as implemented in the Needle program of the EMBOSS package (EMBOSS: The European Molecular Biology Open Software Suite, Rice et al., 2000, Trends Genet. 16: 276-277), preferably version 6.1.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

(Identical Residues×100)/(Length of Alignment−
Total Number of Gaps in Alignment)

This alignment for the purposes of determining percentage identity is done using the length of mature region of the sequence of the invention.

The term "variant" refers to a polypeptide having amylase activity and which comprises an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position.

The term "wild-type" amylase means an amylase expressed by a naturally occurring microorganism, such as bacteria, fungi, yeast or certain insects found in nature. In general, the wild-type amylases of most interest herein are Pp.Amy (SEQ ID NO:1) and Pf.Amy (SEQ ID NO:4).

VIII. AMYLASES OF THE INVENTION

Accordingly, the present invention provides variant amylases with improved activity that can be used in various applications, such as starch processing, food, detergent, textile, paper and biofuel or drinking alcohol industries etc.

In general, the variant amylases of the invention have modified, improved biochemical properties as compared to the wild type parent amylases—"G1P", e.g. "generation 1 parent", for example, Pp.Amy (SEQ ID NO:1) and Pf.Amy (SEQ ID NO:4); or a variant or fragment thereof, e.g. G2P (SEQ ID NO:2) or G3P (SEQ ID NO:3). The biochemical properties of the variant amylases that can be improved herein include, but are not limited to enzymatic activity, acid activity, acid tolerance, specific catalytic activity, substrate specificity, thermoactivity, thermostability, and pH stability.

The variant amylases of the invention have one or more improved properties as compared to a parent amylase, such as Pp. Amy G1P (SEQ ID NO:1), Pp. Amy G1V1 (Pp. Amy G2P, SEQ ID NO:2), Pp. Amy G1V2 (SEQ ID NO:5), Pp. Amy G1V3 (SEQ ID NO:6), Pp. Amy G1V4 (SEQ ID NO:7), Pp. Amy G1V5 (SEQ ID NO:8), Pp. Amy G2V1 (Pp. Amy G3P, SEQ ID NO:3), Pf. Amy G1P (SEQ ID NO:4), Pf. Amy G1V1 (SEQ ID NO:9) or Pf. Amy G1V2 (SEQ ID NO:10).

The variant amylases of the invention can have an improvement one or more of a number of biochemical properties, including, but not limited to activity, acid activity, acid tolerance, specific catalytic activity, substrate specificity, thermoactivity, thermostability, and pH stability. In general, improvements are measured as compared to the parent amylase enzyme using an amylase activity assay, e.g. DNS assay as outlined below, under conditions that challenge the variant amylases against the parent enzyme.

In general, improvements are measured as compared to the G1P enzyme using an alkaline protease activity assay, as outlined below, under conditions that challenge the variant alkaline proteases against the G1P enzyme.

Assays for the Determination of Improved Properties

As will be appreciated by those in the art, there are a number of different assays in the art that can be used to evaluate and quantify different improved properties, such as DNS assay (described below), iodine assay, Megazyme Ceralpha kit, Nelson-Somogyi (NS) method, and methods to determine reduction in viscosity of starch suspension (e.g. falling number, Amylograph/Farinograph Test).

A. DNS Assay to Determine Amylase Activity

In some embodiments, a DNS assay is employed to determine amylase activity, such as the one described in the Examples section. First, enzymes from the lysate plates are added to 96 well Biorad PCR plates containing heated corn starch solution with Phosphate buffer. The plates are then incubated followed by being centrifuged at 4,000 rpm for 1 minute and DNS reagent is added to the plate. After that the plates are incubated at 100° C. for 5 minutes and chilled at 4° C. for 2 minutes. Plates are centrifuged at 4,000 rpm for 5 minutes and 100 μL of the above reaction is transferred to NUNC plates. The plates are then read at 540 nm to monitor reducing sugar released due to breakdown of starch.

Activity of an amylase variant is compared to the parent amylase enzyme under the same conditions to determine activity improvement. In some embodiments, the parent amylase enzyme is a polypeptide of SEQ ID NO:1 or SEQ ID NO:4. In some embodiments, the parent amylase enzyme is a polypeptide of SEQ ID NO:2 or SEQ ID NO:3.

As noted above, "improvement" in amylase activity in this context is at least a 1.1 fold increase, with 1.5 fold, 2 fold, 2.5 fold, 3 fold, 3.5 fold, 4 fold, 4.5 fold, 5 fold, 5.5 fold or 6 fold increases all finding use in the present invention.

Alternatively, "improvement" can also be measured as a percentage increase, from 10%, 20%, 30%, 40%, 50%, 75%, 90%, 100%, 200%, 300%, 400%, 500% or 600% increases also finding use in the present invention.

B. Thermostability

In many embodiments, the variant amylases of the invention have increased thermostability, particularly under the starch liquefaction conditions as more fully outlined below. "Thermostability" in this context means that the variant enzymes are more stable than the parent amylase (e.g. SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9 or SEQ ID NO:10) under the same thermal challenge conditions, that is, the activity of the variant is higher than that of the parent under identical conditions (generally using the DNS assay as outlined herein and as shown in Examples section).

The variant amylases of the invention can exhibit increased thermostability as compared to a parent amylase (e.g. SEQ ID NO:1, SEQ ID NO:2, SEQ ID NO:3 or SEQ ID NO:4) at 30° C., 35° C., 40° C., 45° C., 50° C., 55° C., 60° C., 65° C., 70° C., 75° C., 80° C., 85° C., 90° C., 95° C. and/or 100° C. for a period of time, generally ranging from about 5 minutes to 240 minutes, with 5, 10, 15, 30, 45, 60 and 120 minutes finding particular use in the invention.

As discussed herein, "improved thermostability" in this context means retaining more activity over time than the corresponding wild type enzyme. As noted above, "improvement" in amylase activity in this context is at least a 1.1 fold increase, with 1.5 fold, 2 fold, 2.5 fold, 3 fold, 3.5 fold, 4 fold, 4.5 fold, 5 fold, 5.5 fold or 6 fold increases all finding use in the present invention.

Alternatively, "improvement" can also be measured as a percentage increase, from 10%, 20%, 30%, 40%, 50%, 75%, 90%, 100%, 200%, 300%, 400%, 500% or 600% increases also finding use in the present invention.

Accordingly, as shown in the FIGS. 3-6 and 16, a number of variant amylases of the invention exhibit increased thermostability.

C. pH Stability

In many embodiments, the variant amylases of the invention have altered pH activity or stability as compared to the parent amylase. "Increased pH stability" in this context means that the variant enzymes are more stable than the parent amylase (e.g. SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9 or SEQ ID NO:10) under the same pH challenge conditions, that is, the activity of the variant is higher than that of the parent under identical conditions (generally using the DNS assay to determine the activity as outlined herein and as shown in Examples section). "Acid tolerance" in this context means variant enzymes are more stable than the parent amylase (e.g. SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9 or SEQ ID NO:10) under acidic conditions (pH<7), that is, the activity of the variant is higher than that of the parent under identical acidic conditions. DNS assay can be done at a variety of pHs.

As discussed herein, "improved pH stability" in this context means retaining more activity over time than the corresponding wild type enzyme at a particular pH. As noted above, "improvement" in activity in this context is at least a 1.1 fold increase, with 1.5 fold, 2 fold, 2.5 fold, 3 fold, 3.5 fold, 4 fold, 4.5 fold, 5 fold, 5.5 fold or 6 fold increases all finding use in the present invention.

Alternatively, "improvement" can also be measured as a percentage increase, from 10%, 20%, 30%, 40%, 50%, 75%, 90%, 100%, 200%, 300%, 400%, 500% or 600% increases also finding use in the present invention.

D. Specific Activity Assays

In some embodiments, the variant amylases of the invention have increased specific activity as compared to a parent amylase. By "specific activity" herein is meant the activity per amount of enzyme, generally determined by dividing the enzymatic activity of a sample (sometimes measured in "amylase units") by the amount of amylase enzyme, generally determined as is known in the art.

In many embodiments, the variant amylases of the invention have improved specific activity as compared to the parent amylase. "Improved specific activity" in this context means that the variant enzymes have more amylase activity than the parent amylase (e.g. G1P) under the same challenge conditions, that is, the activity of the variant is higher than that of the G1P under identical conditions (generally using the DMC-TNBS assay to determine the activity as outlined herein and as shown in Examples section).

As discussed herein, "improved specific activity" in this context means higher activity over time than the corresponding wild type enzyme at a particular challenge condition. As noted above, "improvement" in activity in this context is at least a 1.1 fold increase, with 1.5 fold, 2 fold, 2.5 fold, 3 fold, 3.5 fold, 4 fold, 4.5 fold, 5 fold, 5.5 fold or 6 fold increases all finding use in the present invention.

Alternatively, "improvement" can also be measured as a percentage increase, from 10%, 20%, 30%, 40%, 50%, 75%, 90%, 100%, 200%, 300%, 400%, 500% or 600% increases also finding use in the present invention.

E. Protease Susceptibility

In some embodiments, the variant amylases of the invention are less susceptible to protease degradation than the parent enzyme under identical conditions. In some cases, protease degradation during the production of variant amylases in a production host organism by protease enzymes produced by the host organism can be a problem, thus resulting in lower yield of active enzyme. Similarly, depending on the use of the variant enzymes, for example, in starch processing applications, there may be proteases present in the raw substrates or other enzymes for use in combination that can degrade the amylases during the storage or cleaning process.

This is generally determined as is known in the art, for example by allowing proteolytic degradation and then doing N-terminal sequencing on the resulting fragments to determine the cleavage site(s). In some cases, depending on the variant and the host production organism, there may not be significant proteolytic degradation.

IX. SPECIFIC VARIANT AMYLASES

The present invention provides variant amylase enzymes comprising amino acid substitution(s) at one or more (e.g., several) positions as compared to a parent amylase enzyme. To be clear, the variant amylases of the invention neither have SEQ ID NO:1 nor SEQ ID NO:4. The variant amylases of the invention also excludes the homologs to Pp. Amy and Pf. Amy as shown in FIGS. 9 and 10. Additionally, unless otherwise noted, the variant amylases of the present invention have amylase activity.

In some embodiments, the variant amylase enzyme comprises the amino acid substitution of D165R as compared to SEQ ID NO:1, and exhibits at least 85%, 90%, 95%, 96%, 97%, 98% or 99% identity to SEQ ID NO:2.

In some embodiments, the variant amylase enzyme has SEQ ID NO:2.

In some embodiments, the variant amylase enzyme comprises the amino acid substitution of N325R as compared to SEQ ID NO:2, and exhibits at least 85%, 90%, 95%, 96%, 97%, 98% or 99% identity to SEQ ID NO:3.

In some embodiments, the variant amylase enzyme has SEQ ID NO:3.

In some embodiments, the variant amylase enzyme comprises the amino acid substitution of N325R as compared to SEQ ID NO:1, and exhibits at least 85%, 90%, 95%, 96%, 97%, 98% or 99% identity to SEQ ID NO:5.

In some embodiments, the variant amylase enzyme has SEQ ID NO:5.

In some embodiments, the variant amylase enzyme comprises the amino acid substitution of D165N as compared to SEQ ID NO:1, and exhibits at least 85%, 90%, 95%, 96%, 97%, 98% or 99% identity to SEQ ID NO:6.

In some embodiments, the variant amylase enzyme has SEQ ID NO:6.

In some embodiments, the variant amylase enzyme comprises the amino acid substitution of I22A as compared to SEQ ID NO:1, and exhibits at least 85%, 90%, 95%, 96%, 97%, 98% or 99% identity to SEQ ID NO:7.

In some embodiments, the variant amylase enzyme has SEQ ID NO:7.

In some embodiments, the variant amylase enzyme has the amino acid substitution of Y420T as compared to SEQ ID NO:1, and exhibits at least 85%, 90%, 95%, 96%, 97%, 98% or 99% identity to SEQ ID NO:8.

In some embodiments, the variant amylase enzyme has SEQ ID NO:8.

In some embodiments, the variant amylase enzyme has the amino acid substitution of V107I/Y306H/K383N as compared to SEQ ID NO:4, and exhibits at least 85%, 90%, 95%, 96%, 97%, 98% or 99% identity to SEQ ID NO:9.

In some embodiments, the variant amylase enzyme has SEQ ID NO:9.

In some embodiments, the variant amylase enzyme has the amino acid substitution of D19K as compared to SEQ ID NO:4, and exhibits at least 85%, 90%, 95%, 96%, 97%, 98% or 99% identity to SEQ ID NO:10.

In some embodiments, the variant amylase enzyme has SEQ ID NO:10.

In some embodiments, the parent amylase enzyme is SEQ ID NO:1. In some embodiments, the variant has at least 80%, at least 85%, at least 90%, at least 95%, at least 96%, at least 97%, at least 98%, or at least 99%, but less than 100% sequence identity to the polypeptide of SEQ ID NO:1. In some embodiments, the amino acid substitution (s) correspond to positions 18, 19, 22, 35, 54, 71, 75, 130, 165, 175, 182, 187, 232, 233, 262, 266, 271, 321, 325, 351, 372, 377, 378, 384, 392, 393, 394, 395, 417 and 420 as compared to SEQ ID NO:1.

In some embodiments, the variant amylase enzyme as described herein comprises at least one amino acid substitution as compared to SEQ ID NO:1, wherein said variant enzyme has amylase activity, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T.

In some embodiments, the parent amylase enzyme is SEQ ID NO:2. In some embodiments, the variant has at least 80%, at least 85%, at least 90%, at least 95%, at least 96%, at least 97%, at least 98%, or at least 99%, but less than 100% sequence identity to the polypeptide of SEQ ID NO:2. In some embodiments, the amino acid substitution (s) correspond to positions 18, 54, 175, 262, 321, 325 and 377 as compared to SEQ ID NO:2.

In some embodiments, the parent amylase enzyme is SEQ ID NO:3. In some embodiments, the variant has at least 80%, at least 85%, at least 90%, at least 95%, at least 96%, at least 97%, at least 98%, or at least 99%, but less than 100% sequence identity to the polypeptide of SEQ ID NO:3. In some embodiments, the amino acid substitution (s) correspond to positions 18, 35, 54, 75, 175, 182, 187, 232, 262, 271, 321, 325, 351, 372, 377, 378, 384, 392, 393 and 395 as compared to SEQ ID NO:3.

In some embodiments, the parent amylase enzyme is SEQ ID NO:4. In some embodiments, the variant has at least 80%, at least 85%, at least 90%, at least 95%, at least 96%, at least 97%, at least 98%, or at least 99%, but less than 100% sequence identity to the polypeptide of SEQ ID NO:4. In some embodiments, the amino acid substitution (s) correspond to positions 19, 67, 83, 107, 113, 139, 271, 272, 275, 280, 306, 317, 338, 344, 351, 383, 384, and 396 as compared to SEQ ID NO:4.

In some embodiments, the variant amylase enzyme as described herein comprises at least one amino acid substitution as compared to SEQ ID NO:4, wherein said variant enzyme has amylase activity, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S.

In some embodiments, the parent amylase enzyme is SEQ ID NO:5. In some embodiments, the variant has at least 80%, at least 85%, at least 90%, at least 95%, at least 96%, at least 97%, at least 98%, or at least 99%, but less than 100% sequence identity to the polypeptide of SEQ ID NO:5. In some embodiments, the amino acid substitution (s) correspond to positions 18, 19, 22, 35, 54, 71, 75, 130, 165, 175, 182, 187, 232, 233, 262, 266, 271, 321, 351, 372, 377, 378, 384, 392, 393, 394, 395, 417 and 420 as compared to SEQ ID NO:5.

In some embodiments, the parent amylase enzyme is SEQ ID NO:6. In some embodiments, the variant has at least 80%, at least 85%, at least 90%, at least 95%, at least 96%, at least 97%, at least 98%, or at least 99%, but less than 100% sequence identity to the polypeptide of SEQ ID NO:6. In some embodiments, the amino acid substitution (s) correspond to positions 18, 19, 22, 35, 54, 71, 75, 130, 175, 182, 187, 232, 233, 262, 266, 271, 321, 325, 351, 372, 377, 378, 384, 392, 393, 394, 395, 417 and 420 as compared to SEQ ID NO:6.

In some embodiments, the parent amylase enzyme is SEQ ID NO:7. In some embodiments, the variant has at least 80%, at least 85%, at least 90%, at least 95%, at least 96%, at least 97%, at least 98%, or at least 99%, but less than 100% sequence identity to the polypeptide of SEQ ID NO:7. In some embodiments, the amino acid substitution (s) correspond to positions 18, 19, 35, 54, 71, 75, 130, 165, 175, 182, 187, 232, 233, 262, 266, 271, 321, 325, 351, 372, 377, 378, 384, 392, 393, 394, 395, 417 and 420 as compared to SEQ ID NO:7.

In some embodiments, the parent amylase enzyme is SEQ ID NO:8. In some embodiments, the variant has at least 80%, at least 85%, at least 90%, at least 95%, at least 96%, at least 97%, at least 98%, or at least 99%, but less than 100% sequence identity to the polypeptide of SEQ ID NO:8. In some embodiments, the amino acid substitution (s) correspond to positions 18, 19, 22, 35, 54, 71, 75, 130, 165, 175, 182, 187, 232, 233, 262, 266, 271, 321, 325, 351, 372, 377, 378, 384, 392, 393, 394, 395, and 417 as compared to SEQ ID NO:8.

In some embodiments, the parent amylase enzyme is SEQ ID NO:9. In some embodiments, the variant has at least 80%, at least 85%, at least 90%, at least 95%, at least 96%, at least 97%, at least 98%, or at least 99%, but less than 100% sequence identity to the polypeptide of SEQ ID NO:9. In some embodiments, the amino acid substitution (s) correspond to positions 19, 67, 83, 113, 139, 271, 272, 275, 280, 317, 338, 344, 351, 384, and 396 as compared to SEQ ID NO:9.

In some embodiments, the parent amylase enzyme is SEQ ID NO:10. In some embodiments, the variant has at least 80%, at least 85%, at least 90%, at least 95%, at least 96%, at least 97%, at least 98%, or at least 99%, but less than 100% sequence identity to the polypeptide of SEQ ID NO:10. In some embodiments, the amino acid substitution (s) correspond to positions 67, 83, 107, 113, 139, 271, 272, 275, 280, 306, 317, 338, 344, 351, 383, 384, and 396 as compared to SEQ ID NO:10.

A. Specific Variants of SEQ ID NO:1

In some embodiments, the variant amylase enzymes comprise at least one amino acid substitution as compared to SEQ ID NO:1, wherein the variant enzyme has amylases activity, and wherein the amino acid substitution is at a position number selected from the group consisting of 18, 19, 22, 35, 54, 71, 75, 130, 165, 175, 182, 187, 232, 233, 262, 266, 271, 321, 325, 351, 372, 377, 378, 384, 392, 393, 394, 395, 417 and 420. In some cases, the variant enzyme can comprise 1, 2, 3, 4, 5, 6, 7, 8, 9, 10, 11, 12, 13, 14, 15, 16, 17 or 18 amino acid substitutions at these positions. In some cases, the variant enzyme can comprise 1, 2, 3, 4, 5, 6 or 7 amino acid substitutions at these positions.

In some embodiments, the variant amylase enzymes comprise one or more (e.g., several) substitutions selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, as compared to a parent amylase enzyme of SEQ ID NO:1.

In some embodiments, the variant amylase enzyme comprises at least one amino acid substitution at position(s) selected from the group consisting of Y420T, N325R, I22A, D165N and D165R, as compared to a parent amylase enzyme of SEQ ID NO:1.

In some embodiments, the variant amylase enzyme is an isolated variant amylase enzyme.

In some embodiments, the variant amylase enzyme as described herein exhibits at least 90%, at least 95%, at least 96%, at least 97%, at least 98%, or at least 99%, but less than 100%, sequence identity to the amino acid sequence of the parent amylase of SEQ ID NO:1, and the variant amylase enzyme is not any one of the homologs to Pp. Amy and Pf. Amy as shown in FIGS. 9 and 10.

In some embodiments, the variant amylase enzyme comprises at least one amino acid substitution as compared to SEQ ID NO:1, wherein said variant enzyme has amylase activity, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, and wherein said variant amylase enzyme exhibits at least 90%, 91%, 92%, 93%, 94%, 95%, 96%, 97%, 98% or 99% identity to SEQ ID NO:1. In some cases, said variant amylase enzymes as described herein exhibit at least 95% or 98% identity to SEQ ID NO:1.

In some embodiments, the variant amylase enzyme comprises at least one amino acid substitution as compared to SEQ ID NO:1, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, wherein said variant amylase enzyme exhibits at least 95% identity to SEQ ID NO:1, and wherein said variant enzyme has at least 1.1 fold better amylase activity as compared to SEQ ID NO:1 under a condition selected from the group consisting of thermostability at 70° C., thermostability at 75° C., thermostability at 80° C., thermostability at 85° C., thermostability at 90° C., thermostability at 95° C., and thermostability at 100° C. In some cases, the variant enzyme has at least 1.1 fold better amylase activity as compared to SEQ ID NO:1 under a condition selected from the group consisting of thermostability at 70° C., thermostability at 78° C., thermostability at 85° C., thermostability at 95° C., and thermostability at 100° C.

In some embodiments, the variant amylase enzyme comprises at least one amino acid substitution as compared to SEQ ID NO:1, wherein said amino acid substitution is selected from the group consisting of: P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, wherein said variant amylase enzyme exhibits at least 95% identity to SEQ ID NO:1, and wherein said variant enzyme has at least 1.1 fold better amylase activity as compared to SEQ ID NO:1 under a condition selected from the group consisting of pH at 4.0, pH at 4.2, pH at 4.4, pH at 4.6, pH at 4.8, pH at 5.0, pH at 5.2, pH at 5.4, pH at 5.6, pH at 5.8 and pH at 6. In some cases, the variant enzyme has at least 1.1 fold better amylase activity as compared to SEQ ID NO:1 under a condition of pH at 4.6 or pH at 6.

In some embodiments, the variant amylase enzyme comprises at least one amino acid substitution as compared to SEQ ID NO:1 as described herein, wherein said variant amylase enzyme exhibits at least 90%, 91%, 92%, 93%, 94%, 95%, 96%, 97%, 98% or 99% identity to SEQ ID NO:1.

In some embodiments, the variant amylase enzyme comprises at least one amino acid substitution as compared to SEQ ID NO:1 as described herein, wherein said variant amylase enzyme has one of said amino acid substitution, two of said amino acid substitutions, three of said amino acid substitutions, four of said amino acid substitutions, five of said amino acid substitutions, six of said amino acid substitutions, or seven of said amino acid substitutions.

In some embodiments, the variant amylase enzyme comprises at least one amino acid substitution as compared to SEQ ID NO:1, wherein said amino acid substitution(s) is selected from the group consisting of: E19A, N266T, R233H, N266C, A417G, E19D, Y420T, N325Y, Y420L, Y71W, N325V, G394N, G394T, N325F, K130R, N325T, G394P, N325R, I22A, D165N, D165R, D165R/N325A, D165R/N325L, D165R/N325G, D165R/N325C, P18T/ D165R, D165R/N325K, D165R/A175N, D165R/N325S, D165R/N325T, D165R/N325R, D165R/N325M, D165R/ S262R, D165R/N325F, D165R/N325H, D165R/N325P, P18T/D165R/N325L, G54F/D165R, G54N/D165R, D165R/D321T, D165R/Y377H, P18T/D165R/Y377C, G54S/D165R, D165R/N325R/L393N/G395E, D165R/ N325R/L393K, D165R/N325R/N392K/L393R, D165R/ N325R/L393Q, D165R/N325R/A372S, D165R/N325R/ A372P, D165R/N325R/L393P, A35V/D165R/N325R, D165R/N325R/L393S, D165R/N325R/L393A, D165R/ N325R/L393E, D165R/N325R/S384T, D165R/N325R/ L393R, D165R/V187I/N325R, T75S/D165R/N325R, D165R/V271M/N325R, D165R/N325R/V378C, D165R/ A182W/N325R, D165R/V271S/N325R, D165R/N325R/ V351T, D165R/I232K/N325R, P18T/D165R/A175N/ N325R/Y377C, G54N/D165R/N325R/Y377Q, D165R/ A175N/N325R, G54N/D165R/N325R/Y377H, P18T/ G54N/D165R/N325R, G54N/D165R/N325R/Y377C, P18T/G54N/D165R/N325K/Y377Q, P18T/D165R/N325R/ Y377C, P18T/G54N/D165R/D321T/N325R, G54N/ D165R/A175N/N325R, D165R/A175N/N325H/Y377C, P18T/G54F/D165R/A175N/D321T/N325R/Y377C, P18T/ D165R/A175N/N325R, D165R/N325R/Y377H, D165R/ A175N/N325R/Y377C, G54F/D165R/A175N/N325R, G54F/D165R/A175N/D321T/N325L/Y377C, G54N/ D165R/N325R, D165R/S262R/D321T/N325R/Y377H, G54N/D165R/N325L/Y377H, and D165R/S262R/N325R.

In some embodiments, the variant amylase enzyme comprises at least one amino acid substitution as compared to SEQ ID NO:1, wherein said amino acid substitution(s) is selected from the group consisting of: Y420T, N325R, I22A, D165N, D165R, and D165R/N325R.

In some embodiments, the variant amylase enzyme comprises at least one amino acid substitution as compared to SEQ ID NO:1, wherein said amino acid substitution comprises Y420T, and wherein said variant amylase enzyme exhibits at least 90% identity to SEQ ID NO:8.

In some embodiments, the variant amylase enzyme has SEQ ID NO:8.

In some embodiments, the variant amylase enzyme comprises at least one amino acid substitution as compared to SEQ ID NO:1, wherein said amino acid substitution comprises N325R, and wherein said variant amylase enzyme exhibits at least 90% identity to SEQ ID NO:5.

In some embodiments, the variant amylase enzyme has SEQ ID NO:5.

In some embodiments, the variant amylase enzyme comprises at least one amino acid substitution as compared to SEQ ID NO:1, wherein said amino acid substitution comprises I22A, and wherein said variant amylase enzyme exhibits at least 90% identity to SEQ ID NO:7.

In some embodiments, the variant amylase enzyme has SEQ ID NO:7.

In some embodiments, the variant amylase enzyme comprises at least one amino acid substitution as compared to SEQ ID NO:1, wherein said amino acid substitution comprises D165N, and wherein said variant amylase enzyme exhibits at least 90% identity to SEQ ID NO:6.

In some embodiments, the variant amylase enzyme has SEQ ID NO:6.

In some embodiments, the variant amylase enzyme comprises at least one amino acid substitution as compared to SEQ ID NO:1, wherein said amino acid substitution comprises D165R, and wherein said variant amylase enzyme exhibits at least 90% identity to SEQ ID NO:2.

In some embodiments, the variant amylase enzyme has SEQ ID NO:2.

In some embodiments, the variant amylase enzyme comprises at least one amino acid substitution as compared to SEQ ID NO:1, wherein said amino acid substitutions comprise D165R/N325R, and wherein said variant amylase enzyme exhibits at least 90% identity to SEQ ID NO:3.

In some embodiments, the variant amylase enzyme has SEQ ID NO:3.

In some embodiments, the variant amylase enzyme comprises an amino acid substitution at position 18. In some embodiments, the substitution is with any other of the 19 naturally occurring amino acids, namely serine, glutamic acid, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T as compared to SEQ ID NO:1.

In some embodiments, the variant amylase enzyme comprises an amino acid substitution at position 19. In some embodiments, the substitution is with any other of the 19 naturally occurring amino acids, namely serine, threonine, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 19 is substituted with alanine (A). In some embodiments, the amino acid at position 19 is substituted with aspartic acid (D). In some embodiments, the glutamic acid (E) at position 19 is substituted with alanine (A) or aspartic acid (D). In some embodiments, the variant amylase enzyme comprises or consists of the substitution E19A or E19D as compared to SEQ ID NO:1.

In some embodiments, the variant amylase enzyme comprises an amino acid substitution at position 22. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 22 is substituted with alanine (A). In some embodiments, the isoleucine (I) at position 22 is substituted with alanine (A). In some embodiments, the variant amylase enzyme comprises or consists of the substitution I22A as compared to SEQ ID NO:1.

In some embodiments, the variant amylase enzyme comprises an amino acid substitution at position 35. In some embodiments, the substitution is with any other of the 19 naturally occurring amino acids, namely serine, threonine, asparagine, glutamic acid, glutamine, aspartic acid, lysine, arginine, histidine, cysteine, glycine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V as compared to SEQ ID NO:1.

In some embodiments, the variant amylase enzyme comprises an amino acid substitution at position 54. In some embodiments, the substitution is with any other of the 19 naturally occurring amino acids, namely serine, threonine, asparagine, glutamic acid, glutamine, aspartic acid, lysine, arginine, histidine, cysteine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F). In some embodiments, the amino acid at position 54 is substituted with asparagine (N). In some embodiments, the amino acid at position 54 is substituted with serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S as compared to SEQ ID NO:1.

In some embodiments, the variant amylase enzyme comprises an amino acid substitution at position 71. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, and valine with some embodiments not utilizing cysteine (due to possible disulfide formation) or proline (due to steric effects). In some embodiments, the amino acid at position 71 is substituted with tryptophan (W). In some embodiments, the tyrosine (Y) at position 71 is substituted with tryptophan (W). In some embodiments, the variant amylase enzyme comprises or consists of the substitution Y71W as compared to SEQ ID NO:1.

In some embodiments, the variant amylase enzyme comprises an amino acid substitution at position 75. In some embodiments, the substitution is with any other of the 19 naturally occurring amino acids, namely serine, asparagine, glutamic acid, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S as compared to SEQ ID NO:1.

In some embodiments, the variant amylase enzyme comprises an amino acid substitution at position 130. In some embodiments, the substitution is with any other of the 19 naturally occurring amino acids, namely serine, threonine, asparagine, glutamine, glutamic acid, aspartic acid, arginine, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 130 is substituted with arginine (R). In some embodiments, the lysine (K) at position 130 is substituted with arginine (R). In some embodiments, the variant amylase enzyme comprises or consists of the substitution K130R as compared to SEQ ID NO:1.

In some embodiments, the variant amylase enzyme comprises an amino acid substitution at position 165. In some embodiments, the substitution is with any other of the 19 naturally occurring amino acids, namely serine, threonine, asparagine, glutamine, lysine, arginine, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 165 is substituted with asparagine (N). In some embodiments, the amino acid at position 165 is substituted with arginine (R). In some embodiments, the aspartic acid (D) at position 165 is substituted with asparagine (N) or arginine (R). In some embodiments, the variant amylase enzyme comprises or consists of the substitution D165N or D165R as compared to SEQ ID NO:1.

In some embodiments, the variant amylase enzyme comprises an amino acid substitution at position 175. In some embodiments, the substitution is with any other of the 19 naturally occurring amino acids, namely serine, threonine, asparagine, glutamic acid, glutamine, aspartic acid, lysine, arginine, histidine, cysteine, glycine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N as compared to SEQ ID NO:1.

In some embodiments, the variant amylase enzyme comprises an amino acid substitution at position 182. In some embodiments, the substitution is with any other of the 19 naturally occurring amino acids, namely serine, threonine, asparagine, glutamic acid, glutamine, aspartic acid, lysine, arginine, histidine, cysteine, glycine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W as compared to SEQ ID NO:1.

In some embodiments, the variant amylase enzyme comprises an amino acid substitution at position 187. In some embodiments, the substitution is with any other of the 19 naturally occurring amino acids, namely serine, alanine, threonine, asparagine, glutamic acid, glutamine, aspartic acid, lysine, arginine, histidine, cysteine, glycine, isoleucine, leucine, methionine, proline, phenylalanine, tryptophan, and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I as compared to SEQ ID NO:1.

In some embodiments, the variant amylase enzyme comprises an amino acid substitution at position 232. In some embodiments, the substitution is with any other of the 19 naturally occurring amino acids, namely serine, valine, alanine, threonine, asparagine, glutamic acid, glutamine, aspartic acid, lysine, arginine, histidine, cysteine, glycine, leucine, methionine, proline, phenylalanine, tryptophan, and tyrosine, with some embodiments not utilizing cysteine (due to possible disulfide formation) or proline (due to steric effects). In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K as compared to SEQ ID NO:1.

In some embodiments, the variant amylase enzyme comprises an amino acid substitution at position 233. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 233 is substituted with histidine (H). In some embodiments, the arginine (R) at position 233 is substituted with histidine (H). In some embodiments, the variant amylase enzyme comprises or consists of the substitution R233H as compared to SEQ ID NO:1.

In some embodiments, the variant amylase enzyme comprises an amino acid substitution at position 262. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R as compared to SEQ ID NO:1.

In some embodiments, the variant amylase enzyme comprises an amino acid substitution at position 266. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing proline (due to steric effects). In some embodiments, the amino acid at position 266 is substituted with cysteine (C). In some embodiments, the amino acid at position 266 is substituted with threonine (T). In some embodiments, the asparagine (N) at position 266 is substituted with threonine (T) or cysteine (C). In some embodiments, the variant amylase enzyme comprises or consists of the substitution N266T or N266C as compared to SEQ ID NO:1.

In some embodiments, the variant amylase enzyme comprises an amino acid substitution at position 271. In some embodiments, the substitution is with any other of the 19 naturally occurring amino acids, namely serine, threonine, asparagine, glutamic acid, glutamine, aspartic acid, lysine, arginine, histidine, cysteine, glycine, alanine, isoleucine, leucine, methionine, proline, phenylalanine, tryptophan, and tyrosine, with some embodiments not utilizing cysteine (due to possible disulfide formation) or proline (due to steric effects). In some embodiments, the amino acid at position 271 is substituted with methionine (M). In some embodiments, the amino acid at position 271 is substituted with serine (S). In some embodiments, the valine (V) at position 271 is substituted with methionine (M) or serine (S). In some embodiments, the variant amylase enzyme comprises or consists of the substitution V271M or V271S as compared to SEQ ID NO:1.

In some embodiments, the variant amylase enzyme comprises an amino acid substitution at position 321. In some embodiments, the substitution is with any other of the 19 naturally occurring amino acids, namely serine, threonine, asparagine, glutamine, lysine, glutamic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T as compared to SEQ ID NO:1.

In some embodiments, the variant amylase enzyme comprises an amino acid substitution at position 325. In some embodiments, the substitution is with any other of the 19 naturally occurring amino acids, namely serine, threonine, glutamic acid, glutamine, aspartic acid, lysine, arginine, histidine, cysteine, glycine, alanine, isoleucine, leucine, methionine, proline, phenylalanine, tryptophan, valine and tyrosine. In some embodiments, the amino acid at position 325 is substituted with alanine (A). In some embodiments, the amino acid at position 325 is substituted with cysteine (C). In some embodiments, the amino acid at position 325 is substituted with phenylalanine (F). In some embodiments, the amino acid at position 325 is substituted with glycine (G). In some embodiments, the amino acid at position 325 is substituted with histidine (H). In some embodiments, the amino acid at position 325 is substituted with lysine (K). In some embodiments, the amino acid at position 325 is substituted with leucine (L). In some embodiments, the amino acid at position 325 is substituted with methionine (M). In some embodiments, the amino acid at position 325 is substituted with proline (P). In some embodiments, the amino acid at position 325 is substituted with arginine (R). In some embodiments, the amino acid at position 325 is substituted with serine (S). In some embodiments, the amino acid at position 325 is substituted with threonine (T). In some embodiments, the amino acid at position 325 is substituted with valine (V). In some embodiments, the amino acid at position 325 is substituted with tyrosine (Y). In some embodiments, the amino acid at position 325 is substituted with alanine (A), cysteine (C), phenylalanine (F), glycine (G), histidine (H), lysine (K), leucine (L), methionine (M), proline (P), arginine (R), serine (S), threonine (T), valine (V) or tyrosine (Y). In some embodiments, the asparagine (N) at position 325 is substituted with alanine (A), cysteine (C), phenylalanine (F), glycine (G), histidine (H), lysine (K), leucine (L), methionine (M), proline (P), arginine (R), serine (S), threonine (T), valine (V) or tyrosine (Y). In some embodiments, the variant amylase enzyme comprises or consists of the substitution N325A, N325C, N325F, N325G, N325H, N325K, N325L, N325M, N325P, N325R, N325S, N325T, N325V or N325Y as compared to SEQ ID NO:1.

In some embodiments, the variant amylase enzyme comprises an amino acid substitution at position 351. In some embodiments, the substitution is with any other of the 19 naturally occurring amino acids, namely serine, threonine, asparagine, glutamic acid, glutamine, aspartic acid, lysine, arginine, histidine, cysteine, glycine, alanine, isoleucine, leucine, methionine, proline, phenylalanine, tryptophan and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T as compared to SEQ ID NO:1.

In some embodiments, the variant amylase enzyme comprises an amino acid substitution at position 372. In some embodiments, the substitution is with any other of the 19 naturally occurring amino acids, namely serine, threonine, asparagine, glutamic acid, glutamine, aspartic acid, lysine, arginine, histidine, cysteine, glycine, isoleucine, leucine, methionine, proline, phenylalanine, tryptophan, valine and tyrosine, with some embodiments not utilizing cysteine (due to possible disulfide formation). In some embodiments, the amino acid at position 372 is substituted with proline (P). In some embodiments, the amino acid at position 372 is substituted with serine (S). In some embodiments, the alanine (A) at position 372 is substituted with proline (P) or serine (S). In some embodiments, the variant amylase enzyme comprises or consists of the substitution A372P or A372S as compared to SEQ ID NO:1.

In some embodiments, the variant amylase enzyme comprises an amino acid substitution at position 377. In some embodiments, the substitution is with any other of the 19 naturally occurring amino acids, namely serine, threonine, asparagine, glutamic acid, glutamine, aspartic acid, lysine, arginine, histidine, cysteine, glycine, alanine, isoleucine, leucine, methionine, proline, phenylalanine, tryptophan, and valine, with some embodiments not utilizing proline (due to steric effects). In some embodiments, the amino acid at position 377 is substituted with cysteine (C). In some embodiments, the amino acid at position 377 is substituted with histidine (H). In some embodiments, the amino acid at position 377 is substituted with glutamine (Q). In some embodiments, the tyrosine (Y) at position 377 is substituted with cysteine (C), histidine (H) or glutamine (Q). In some embodiments, the variant amylase enzyme comprises or consists of the substitution Y377C, Y377H or Y377Q as compared to SEQ ID NO:1.

In some embodiments, the variant amylase enzyme comprises an amino acid substitution at position 378. In some embodiments, the substitution is with any other of the 19 naturally occurring amino acids, namely serine, threonine, asparagine, glutamic acid, glutamine, aspartic acid, lysine, arginine, histidine, cysteine, glycine, alanine, isoleucine, leucine, methionine, proline, phenylalanine, tryptophan and tyrosine, with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C as compared to SEQ ID NO:1.

In some embodiments, the variant amylase enzyme comprises an amino acid substitution at position 384. In some embodiments, the substitution is with any other of the 19 naturally occurring amino acids, namely threonine, valine, asparagine, glutamic acid, glutamine, aspartic acid, lysine, arginine, histidine, cysteine, glycine, alanine, isoleucine, leucine, methionine, proline, phenylalanine, tryptophan and tyrosine, with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T as compared to SEQ ID NO:1.

In some embodiments, the variant amylase enzyme comprises an amino acid substitution at position 392. In some embodiments, the substitution is with any other of the 19 naturally occurring amino acids, namely threonine, serine, valine, glutamic acid, glutamine, aspartic acid, lysine, arginine, histidine, cysteine, glycine, alanine, isoleucine, leucine, methionine, proline, phenylalanine, tryptophan and tyrosine, with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K as compared to SEQ ID NO:1.

In some embodiments, the variant amylase enzyme comprises an amino acid substitution at position 393. In some embodiments, the substitution is with any other of the 19 naturally occurring amino acids, namely threonine, serine, valine, glutamic acid, asparagine, glutamine, aspartic acid, lysine, arginine, histidine, cysteine, glycine, alanine, isoleucine, methionine, proline, phenylalanine, tryptophan and tyrosine, with some embodiments not utilizing cysteine (due to possible disulfide formation). In some embodiments, the amino acid at position 393 is substituted with alanine (A). In some embodiments, the amino acid at position 393 is substituted with glutamic acid (E). In some embodiments, the amino acid at position 393 is substituted with lysine (K). In some embodiments, the amino acid at position 393 is substituted with asparagine (N). In some embodiments, the amino acid at position 393 is substituted with proline (P). In some embodiments, the amino acid at position 393 is substituted with glutamine (Q). In some embodiments, the amino acid at position 393 is substituted with arginine (R). In some embodiments, the amino acid at position 393 is substituted with serine (S). In some embodiments, the leucine (L) at position 393 is substituted with alanine (A), glutamic acid (E), lysine (K), asparagine (N), proline (P), glutamine (Q), arginine (R) or serine (S). In some embodiments, the variant amylase enzyme comprises or consists of the substitution L393A, L393E, L393K, L393N, L393P, L393Q, L393R or L393S as compared to SEQ ID NO:1.

In some embodiments, the variant amylase enzyme comprises an amino acid substitution at position 394. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid methionine, proline, phenylalanine, tryptophan, valine and tyrosine, with some embodiments not utilizing cysteine (due to possible disulfide formation). In some embodiments, the amino acid at position 394 is substituted with asparagine (N). In some embodiments, the amino acid at position 394 is substituted with threonine (T). In some embodiments, the amino acid at position 394 is substituted with proline (P). In some embodiments, the glycine (G) at position 394 is substituted with asparagine (N), threonine (T) or proline (P). In some embodiments, the variant amylase enzyme comprises or consists of the substitution G394N, G394T or G394P as compared to SEQ ID NO:1.

In some embodiments, the variant amylase enzyme comprises an amino acid substitution at position 395. In some embodiments, the substitution is with any other of the 19 naturally occurring amino acids, namely serine, threonine, asparagine, glutamic acid, glutamine, aspartic acid, lysine, arginine, histidine, cysteine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E as compared to SEQ ID NO:1.

In some embodiments, the variant amylase enzyme comprises an amino acid substitution at position 417. In some embodiments, the substitution is with any other of the 19 naturally occurring amino acids, namely serine, threonine, asparagine, glutamine, lysine, glutamic acid, aspartic acid, histidine, cysteine, glycine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 417 is substituted with glycine (G). In some embodiments, the alanine (A) at position 417 is substituted with glycine (G). In some embodiments, the variant amylase enzyme comprises or consists of the substitution A417G as compared to SEQ ID NO:1.

In some embodiments, the variant amylase enzyme comprises an amino acid substitution at position 420. In some embodiments, the substitution is with any other of the 19 naturally occurring amino acids, namely serine, threonine, glutamine, lysine, arginine, asparagine, aspartic acid, histidine, cysteine, glycine, alanine, isoleucine, leucine, glutamic acid methionine, proline, phenylalanine, tryptophan, and valine, with some embodiments not utilizing cysteine (due to possible disulfide formation) or proline (due to steric effects). In some embodiments, the amino acid at position 420 is substituted with threonine (T). In some embodiments, the amino acid at position 420 is substituted with leucine (L). In some embodiments, the tyrosine (Y) at position 420 is substituted with threonine (T) or leucine (L). In some embodiments, the variant amylase enzyme comprises or consists of the substitution Y420T or Y420L as compared to SEQ ID NO:1.

In some embodiments, the variant amylase enzymes comprise one or more (e.g., several) substitutions selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372P, A372S, Y377C, Y377H, Y377Q, V378C, S384T, N392K, L393A, L393E, L393K, L393N, L393P, L393Q, L393R, L393S, G394N, G394P, G394T, G395E, A417G, Y420L and Y420T, as compared to a parent amylase enzyme of SEQ ID NO:1, and said variant amylase enzymes are at least 90%, 95%, 96%, 97%, 98% or 99% identical to SEQ ID NO:1.

In some embodiments, the variant amylase enzyme comprises the amino acid substitution of Y420T as compared to SEQ ID NO:1. In some embodiments, the variant amylase enzyme comprises the amino acid substitution of Y420T, are at least 90%, 95%, 96%, 97%, 98% or 99% identical to SEQ ID NO:1.

In some embodiments, the variant amylase enzyme comprises the amino acid substitution of N325R as compared to SEQ ID NO:1. In some embodiments, the variant amylase enzyme comprises the amino acid substitution of N325R, are at least 90%, 95%, 96%, 97%, 98% or 99% identical to SEQ ID NO:1.

In some embodiments, the variant amylase enzyme comprises the amino acid substitution of I22A as compared to SEQ ID NO:1. In some embodiments, the variant amylase enzyme comprises the amino acid substitution of I22A, are at least 90%, 95%, 96%, 97%, 98% or 99% identical to SEQ ID NO:1.

In some embodiments, the variant amylase enzyme comprises the amino acid substitution of D165N as compared to SEQ ID NO:1. In some embodiments, the variant amylase enzyme comprises the amino acid substitution of D165N, are at least 90%, 95%, 96%, 97%, 98% or 99% identical to SEQ ID NO:1.

In some embodiments, the variant amylase enzyme comprises the amino acid substitution of D165R as compared to SEQ ID NO:1. In some embodiments, the variant amylase enzyme comprises the amino acid substitution of D165R, are at least 90%, 95%, 96%, 97%, 98% or 99% identical to SEQ ID NO:1.

In some embodiments, the variant amylase enzyme comprises the amino acid substitutions of D165R/N325R as compared to SEQ ID NO:1. In some embodiments, the variant amylase enzyme comprises the amino acid substitutions of D165R/N325R, are at least 90%, 95%, 96%, 97%, 98% or 99% identical to SEQ ID NO:1.

B. Specific Variants of SEQ ID NO:2

In some embodiments, the variant amylase enzymes comprise one or more (e.g., several) substitutions selected from the group consisting of P18T, G54F, G54N, G54S, A175N, S262R, D321T, N325A, N325L, N325G, N325C, N325K, N325S, N325T, N325R, N325M, N325F, N325H, N325P, Y377H and Y377C as compared to a parent amylase enzyme of SEQ ID NO:2.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:2, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, G54F, G54N, G54S, A175N, S262R, D321T, N325A, N325L, N325G, N325C, N325K, N325S, N325T, N325R, N325M, N325F, N325H, N325P, Y377H, P18T/N325L, and P18T/Y377C as compared to a parent amylase enzyme. In some cases, the variant enzyme can comprise 1, 2, 3, 4, 5, 6, or 7 amino acid substitutions at these positions. In some cases, the variant enzyme can comprise 1, 2, 3, 4, 5 or 6 amino acid substitutions at these positions.

In some embodiments, the variant amylase enzyme has one amino acid substitution of N325R as compared to SEQ ID NO:2, and has SEQ ID NO:3.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:2.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F), asparagine (N) or serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S of SEQ ID NO:2.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:2.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:2.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:2.

In some embodiments, the variant amylase enzyme comprises an amino acid substitution at position 325. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 325 is substituted with alanine (A), leucine (L), glycine (G), cysteine (C), lysine (K), serine (S), threonine (T), arginine (R), methionine (M), phenylalanine (F), histidine (H), proline (P) or leucine (L). In some embodiments, the asparagine (N) at position 325 is substituted with alanine (A), leucine (L), glycine (G), cysteine (C), lysine (K), serine (S), threonine (T), arginine (R), methionine (M), phenylalanine (F), histidine (H), proline (P) or leucine (L). In some embodiments, the variant amylase enzyme comprises or consists of the substitution N325A, N325L, N325G, N325C, N325K, N325S, N325T, N325R, N325M, N325F, N325H, N325P or N325L of SEQ ID NO:2.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing proline (due to steric effects). In some embodiments, the amino acid at position 377 is substituted with histidine (H) or cysteine (C). In some embodiments, the tyrosine (Y) at position 377 is substituted with histidine (H) or cysteine (C). In some embodiments, the variant amylase enzyme comprises or consists of the substitution Y377H or Y377C of SEQ ID NO:2.

In some embodiments, the variant amylase enzyme comprises the variants selected from the group consisting of: P18T, G54F, G54N, G54S, A175N, S262R, D321T, N325A, N325L, N325G, N325C, N325K, N325S, N325T, N325R, N325M, N325F, N325H, N325P, Y377H, P18T/N325L, and P18T/Y377C as compared to SEQ ID NO:2. In some embodiments, the variant amylase enzyme comprises the variants selected from the group consisting of: P18T, G54F, G54N, G54S, A175N, S262R, D321T, N325A, N325L, N325G, N325C, N325K, N325S, N325T, N325R, N325M, N325F, N325H, N325P, Y377H, P18T/N325L, and P18T/Y377C and are at least 90%, 95%, 96%, 97%, 98% or 99% identical to SEQ ID NO:2.

In some embodiments, the variant amylase enzyme comprises the amino acid substitution of N325R as compared to SEQ ID NO:2. In some embodiments, the variant amylase enzyme comprises the amino acid substitution of N325R, are at least 90%, 95%, 96%, 97%, 98% or 99% identical to SEQ ID NO:2.

C. Specific Variants of SEQ ID NO:3

In some embodiments, the variant amylase enzymes comprise one or more (e.g., several) substitutions selected from the group consisting of P18T, A35V, G54N, G54F, T75S, A175N, A182W, V187I, I232K, S262R, V271M, V271S, D321T, R325K, R325H, R325L, V351T, A372S, A372P, Y377C, Y377Q, Y377H, V378C, S384T, N392K, L393N, L393K, L393R, L393Q, L393P, L393S, L393A, L393E and G395E as compared to a parent amylase enzyme of SEQ ID NO:3.

In some embodiments, the variant amylase enzyme is an isolated variant amylase enzyme.

In some embodiments, the variant amylase enzyme exhibits at least 90%, at least 95%, at least 96%, at least 97%, at least 98%, or at least 99%, but less than 100%, sequence identity to the amino acid sequence of the parent amylase of SEQ ID NO:3, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, A35V, G54N, G54F, T75S, A175N, A182W, V187I, I232K, S262R, V271M, V271S, D321T, R325K, R325H, R325L, V351T, A372S, A372P, Y377C, Y377Q, Y377H, V378C, S384T, N392K, L393N, L393K, L393R, L393Q, L393P, L393S, L393A, L393E and G395E as compared to a parent amylase enzyme. In some cases, the variant enzyme can comprise 1, 2, 3, 4, 5, 6, 7, 8, 9, 10, 11, 12, 13, 14, 15, 16, 17, 18, 19 or 20 amino acid substitutions at these positions. In some cases, the variant enzyme can comprise 1, 2, 3, 4, or 5 amino acid substitutions at these positions.

In some embodiments, the variant amylase enzyme comprises at least one amino acid substitution at position(s) selected from the group consisting of L393N/G395E, L393K, N392K/L393R, L393Q, A372S, A372P, L393P, A35V, L393S, L393A, L393E, S384T, L393R, V187I, T75S, V271M, V378C, A182W, V271S, V351T, I232K, P18T/A175N/Y377C, G54N/Y377Q, A175N, G54N/Y377H, P18T/G54N, G54N/Y377C, P18T/G54N/R325K/Y377Q, P18T/Y377C, P18T/G54N/D321T, G54N/A175N, A175N/R325H/Y377C, P18T/G54F/A175N/D321T/Y377C, P18T/A175N, Y377H, A175N/Y377C, G54F/A175N, G54F/A175N/D321T/R325L/Y377C, G54N, S262R/D321T/Y377H, G54N/R325L/Y377H and S262R.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:3.

In some embodiments, the variant amylase enzyme comprises an amino acid substitution at position 35. In some embodiments, the substitution is with any other of the 19 naturally occurring amino acids, namely serine, threonine, asparagine, glutamine, isoleucine, aspartic acid, lysine, arginine, histidine, cysteine, glycine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V of SEQ ID NO:3.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with asparagine (N) or phenylalanine (F). In some embodiments, the variant amylase enzyme comprises or consists of the substitution G54N or G54F of SEQ ID NO:3.

In some embodiments, the variant amylase enzyme comprises an amino acid substitution at position 75. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S of SEQ ID NO:3.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:3.

In some embodiments, the variant amylase enzyme comprises an amino acid substitution at position 182. In some embodiments, the substitution is with any other of the 19 naturally occurring amino acids, namely serine, threonine, asparagine, glutamine, aspartic acid, lysine, arginine, histidine, cysteine, glycine, leucine, methionine, isoleucine, glutamic acid, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W of SEQ ID NO:3.

In some embodiments, the variant amylase enzyme comprises an amino acid substitution at position 187. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, isoleucine, glutamic acid, proline, phenylalanine, tryptophan and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I of SEQ ID NO:3.

In some embodiments, the variant amylase enzyme comprises an amino acid substitution at position 232. In some embodiments, the substitution is with any other of the 19 naturally occurring amino acids, namely serine, threonine, asparagine, valine, glutamine, aspartic acid, lysine, arginine, histidine, cysteine, glycine, alanine, leucine, methionine, glutamic acid, proline, phenylalanine, tryptophan and tyrosine, with some embodiments not utilizing cysteine (due to possible disulfide formation) or proline (due to steric effects). In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K of SEQ ID NO:3.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:3.

In some embodiments, the variant amylase enzyme comprises an amino acid substitution at position 271. In some embodiments, the substitution is with any other of the 19 naturally occurring amino acids, namely serine, threonine, alanine, asparagine, serine, glutamine, lysine, arginine, glutamic acid, histidine, cysteine, aspartic acid, glycine, isoleucine, leucine, methionine, proline, phenylalanine, tryptophan and tyrosine with some embodiments not utilizing cysteine (due to possible disulfide formation) or proline (due to steric effects). In some embodiments, the amino acid at position 271 is substituted with methionine (M) or serine (S). In some embodiments, the valine (V) at position 271 is substituted with methionine (M) or serine (S). In some embodiments, the variant amylase enzyme comprises or consists of the substitution V271M or V271S of SEQ ID NO:3.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:3.

In some embodiments, the variant amylase enzyme comprises an amino acid substitution at position 325. In some embodiments, the substitution is with any other of the 19 naturally occurring amino acids, namely serine, threonine, glutamine, lysine, asparagine, arginine, aspartic acid, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 325 is substituted with lysine (K), histidine (H) or leucine (L). In some embodiments, the arginine (R) at position 325 is substituted with lysine (K), histidine (H) or leucine (L). In some embodiments, the variant amylase enzyme comprises or consists of the substitution R325K, R325H or R325L of SEQ ID NO:3.

In some embodiments, the variant amylase enzyme comprises an amino acid substitution at position 351. In some embodiments, the substitution is with any other of the 19 naturally occurring amino acids, namely serine, threonine, asparagine, glutamine, aspartic acid, lysine, arginine, histidine, cysteine, glycine, isoleucine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T of SEQ ID NO:3.

In some embodiments, the variant amylase enzyme comprises an amino acid substitution at position 372. In some embodiments, the substitution is with any other of the 19 naturally occurring amino acids, namely serine, threonine, asparagine, glutamine, glutamic acid, aspartic acid, lysine, arginine, histidine, cysteine, glycine, tyrosine, isoleucine, leucine, methionine, proline, phenylalanine, tryptophan, and valine with some embodiments not utilizing cysteine (due to possible disulfide formation). In some embodiments, the amino acid at position 372 is substituted with serine (S) or proline (P). In some embodiments, the alanine (A) at position 372 is substituted with serine (S) or proline (P). In some embodiments, the variant amylase enzyme comprises or consists of the substitution A372S or A372P of SEQ ID NO:3.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing proline (due to steric effects). In some embodiments, the amino acid at position 377 is substituted with cysteine (C), glutamine (Q) or histidine (H). In some embodiments, the tyrosine (Y) at position 377 is substituted with cysteine (C), glutamine (Q) or histidine (H). In some embodiments, the variant amylase enzyme comprises or consists of the substitution Y377C, Y377Q or Y377H of SEQ ID NO:3.

In some embodiments, the variant amylase enzyme comprises an amino acid substitution at position 378. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, arginine, methionine, proline, phenylalanine, tryptophan and tyrosine with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C of SEQ ID NO:3.

In some embodiments, the variant amylase enzyme comprises an amino acid substitution at position 384. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T of SEQ ID NO:3.

In some embodiments, the variant amylase enzyme comprises an amino acid substitution at position 392. In some embodiments, the substitution is with any other of the 19 naturally occurring amino acids, namely threonine, glutamine, lysine, serine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K of SEQ ID NO:3.

In some embodiments, the variant amylase enzyme comprises an amino acid substitution at position 393. In some embodiments, the substitution is with any other of the 19 naturally occurring amino acids, namely serine, threonine, asparagine, glutamine, lysine, aspartic acid, arginine, histidine, cysteine, glycine, alanine, isoleucine, glutamic acid methionine, proline, phenylalanine, tryptophan, valine and tyrosine, with some embodiments not utilizing cysteine (due to possible disulfide formation). In some embodiments, the amino acid at position 393 is substituted with asparagine (N), lysine (K), arginine (R), glutamine (Q), proline (P), serine (S), alanine (A) or glutamic acid (E). In some embodiments, the leucine (L) at position 393 is substituted with asparagine (N), lysine (K), arginine (R), glutamine (Q), proline (P), serine (S), alanine (A) or glutamic acid (E). In some embodiments, the variant amylase enzyme comprises or consists of the substitution L393N, L393K, L393R, L393Q, L393P, L393S, L393A or L393E of SEQ ID NO:3.

In some embodiments, the variant amylase enzyme comprises an amino acid substitution at position 395. In some embodiments, the substitution is with any other of the 19 naturally occurring amino acids, namely threonine, glutamine, lysine, serine, glutamic acid, aspartic acid, histidine, cysteine, alanine, isoleucine, leucine, arginine, asparagine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E of SEQ ID NO:3.

In some embodiments, the variant amylase enzyme comprises the variants selected from the group consisting of: L393N/G395E, L393K, N392K/L393R, L393Q, A372S, A372P, L393P, A35V, L393S, L393A, L393E, S384T, L393R, V187I, T75S, V271M, V378C, A182W, V271S, V351T, I232K, P18T/A175N/Y377C, G54N/Y377Q, A175N, G54N/Y377H, P18T/G54N, G54N/Y377C, P18T/G54N/R325K/Y377Q, P18T/Y377C, P18T/G54N/D321T, G54N/A175N, A175N/R325H/Y377C, P18T/G54F/A175N/D321T/Y377C, P18T/A175N, Y377H, A175N/Y377C, G54F/A175N, G54F/A175N/D321T/R325L/Y377C, G54N, S262R/D321T/Y377H, G54N/R325L/Y377H and S262R as compared to SEQ ID NO:3. In some embodiments, the variant amylase enzyme comprises the variants selected from the group consisting of: L393N/G395E, L393K, N392K/L393R, L393Q, A372S, A372P, L393P, A35V, L393S, L393A, L393E, S384T, L393R, V187I, T75S, V271M, V378C, A182W, V271S, V351T, I232K, P18T/A175N/Y377C, G54N/Y377Q, A175N, G54N/Y377H, P18T/G54N, G54N/Y377C, P18T/G54N/R325K/Y377Q, P18T/Y377C, P18T/G54N/D321T, G54N/A175N, A175N/R325H/Y377C, P18T/G54F/A175N/D321T/Y377C, P18T/A175N, Y377H, A175N/Y377C, G54F/A175N, G54F/A175N/D321T/R325L/Y377C, G54N, S262R/D321T/Y377H, G54N/R325L/Y377H and S262R, and are at least 90%, 95%, 96%, 97%, 98% or 99% identical to SEQ ID NO:3.

D. Specific Variants of SEQ ID NO:4

In some embodiments, the variant amylase enzymes comprise at least one amino acid substitution as compared to SEQ ID NO:4, wherein the variant enzyme has amylases activity, and wherein the amino acid substitution is at a position number selected from the group consisting of 19, 67, 83, 107, 113, 139, 271, 272, 275, 280, 306, 317, 338, 344, 351, 383, 384, and 396. In some cases, the variant enzyme can comprise 1, 2, 3, 4, 5, 6, 7, 8, 9, 10, 11, 12, 13, 14, 15, 16, 17 or 18 amino acid substitutions at these positions. In some cases, the variant enzyme can comprise 1, 2, 3, 4, 5, 6 or 7 amino acid substitutions at these positions.

In some embodiments, the variant amylase enzymes comprise one or more (e.g., several) substitutions selected from the group consisting of D19K, Y67L, F83L, V107I, A113S, Y139F, Q271D, T272N, T272M, S275K, K280Q, Y306H, F317Y, G338D, V344L, L351Y, K383N, F384W and L396S as compared to a parent amylase enzyme of SEQ ID NO:4.

In some embodiments, the variant amylase enzyme is an isolated variant amylase enzyme.

In some embodiments, the variant amylase enzyme exhibits at least 90%, at least 91%, at least 95%, at least 96%, at least 97%, at least 98% or at least 99%, but less than 100%, sequence identity to the amino acid sequence of the parent amylase of SEQ ID NO:4, and the variant amylase enzyme is not any one of the homologs to Pp. Amy and Pf. Amy as shown in FIGS. 9 and 10.

In some embodiments, the variant amylase enzyme comprises a variant amylase enzyme comprising at least one amino acid substitution as compared to SEQ ID NO:4, wherein said variant enzyme has amylase activity, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S; and wherein said variant amylase enzyme exhibits at least 90%, 91%, 92%, 93%, 94%, 95%, 96%, 97%, 98% or 99% identity to SEQ ID NO:4. In some cases, said variant amylase enzymes as described herein exhibit at least 95% or 98% identity to SEQ ID NO:4.

In some embodiments, the variant amylase enzyme comprises a variant amylase enzyme comprising at least one amino acid substitution as compared to SEQ ID NO:4, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme exhibits at least 95% identity to SEQ ID NO:4, and wherein said variant enzyme has at least 1.1 fold better amylase activity as compared to SEQ ID NO:4 under a condition selected from the group consisting of thermostability at 70° C., thermostability at 75° C., thermostability at 80° C., thermostability at 85° C., thermostability at 90° C., thermostability at 95° C., and thermostability at 100° C. In some cases, the variant enzyme has at least 1.1 fold better amylase activity as compared to SEQ ID NO:4 under a condition of thermostability at 70° C. or thermostability at 100° C.

In some embodiments, the variant amylase enzyme comprises a variant amylase enzyme comprising at least one amino acid substitution as compared to SEQ ID NO:4, wherein said amino acid substitution is selected from the group consisting of: D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme exhibits at least 95% identity to SEQ ID NO:4, and wherein said variant enzyme has at least 1.1 fold better amylase activity as compared to SEQ ID NO:4 under a condition under a condition selected from the group consisting of pH at 4.0, pH at 4.2, pH at 4.4, pH at 4.6, pH at 4.8, pH at 5.0, pH at 5.2, pH at 5.4, pH at 5.6, pH at 5.8 and pH at 6. In some cases, the variant enzyme has at least 1.1 fold better amylase activity as compared to SEQ ID NO:4 under a condition of pH at 4.6 or pH at 6.

In some embodiments, the variant amylase enzyme comprises at least one amino acid substitution as compared to SEQ ID NO:4 as described herein, wherein said variant amylase enzyme exhibits at least 90%, 91%, 92%, 93%, 94%, 95%, 96%, 97%, 98% or 99% identity to SEQ ID NO:4.

In some embodiments, the variant amylase enzyme comprises at least one amino acid substitution as compared to SEQ ID NO:4 as described herein, wherein said variant amylase enzyme has one of said amino acid substitution, two of said amino acid substitutions, three of said amino acid substitutions, four of said amino acid substitutions, five of said amino acid substitutions, six of said amino acid substitutions, or seven of said amino acid substitutions.

In some embodiments, the variant amylase enzyme comprises at least one amino acid substitution as compared to SEQ ID NO:4, wherein said amino acid substitution(s) is selected from the group consisting of: Y67L, D19K, F83L, V107I/Q271D/F317Y/K383N, S275K/K383N, Y139F/K383N, V107I/Y306H/K383N, V107I/Y139F/Q271D/K383N, V107I/Y306H, V107I, Y306H/K383N, L351Y/K383N, Y306H, V107I/Y139F, S275K, Y139F, Y139F/Y306H, Y139F/S275K, F317Y, V107I/K383N, K383N, A113S/V344L/F384W, K280Q/V344L/L396S, T272N/V344L, A113S, G338D/F384W, A113S/V344L, F384W/L396S, L396S and T272M.

In some embodiments, the variant amylase enzyme comprises at least one amino acid substitution as compared to SEQ ID NO:4, wherein said amino acid substitution(s) is D19K or V107I/Y306H/K383N.

In some embodiments, the variant amylase enzyme comprises at least one amino acid substitution as compared to SEQ ID NO:4, wherein said amino acid substitution comprises D19K, and wherein said variant amylase enzyme exhibits at least 90% identity to SEQ ID NO:10.

In some embodiments, the variant amylase enzyme has SEQ ID NO:10.

In some embodiments, the variant amylase enzyme comprises an amino acid substitution at position 19. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid at position 19 is substituted with lysine (K). In some embodiments, the aspartic acid (D) at position 19 is substituted with lysine (K). In some embodiments, the variant amylase enzyme comprises or consists of the substitution D19K of SEQ ID NO:4.

In some embodiments, the variant amylase enzyme comprises an amino acid substitution at position 67. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, phenylalanine, tryptophan, and valine, with some embodiments not utilizing cysteine (due to possible disulfide formation) or proline (due to steric effects). In some embodiments, the amino acid at position 67 is substituted with leucine (L). In some embodiments, the tyrosine (Y) at position 67 is substituted with leucine (L). In some embodiments, the variant amylase enzyme comprises or consists of the substitution Y67L of SEQ ID NO:4.

In some embodiments, the variant amylase enzyme comprises an amino acid substitution at position 83. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 83 is substituted with leucine (L). In some embodiments, the phenylalanine (F) at position 83 is substituted with leucine (L). In some embodiments, the variant amylase enzyme comprises or consists of the substitution F83L of SEQ ID NO:4.

In some embodiments, the variant amylase enzyme comprises an amino acid substitution at position 107. In some embodiments, the substitution is with any other of the 19 naturally occurring amino acids, namely serine, threonine, asparagine, glutamine, proline, lysine, arginine, histidine, glutamic acid, cysteine, glycine, phenylalanine, alanine, isoleucine, leucine, aspartic acid, methionine, tryptophan, and tyrosine, with some embodiments not utilizing cysteine (due to possible disulfide formation) or proline (due to steric effects). In some embodiments, the amino acid at position 107 is substituted with isoleucine (I). In some embodiments, the valine (V) at position 107 is substituted with isoleucine (I). In some embodiments, the variant amylase enzyme comprises or consists of the substitution V107I of SEQ ID NO:4.

In some embodiments, the variant amylase enzyme comprises an amino acid substitution at position 113. In some embodiments, the substitution is with any other of the 19 naturally occurring amino acids, namely threonine, asparagine, glutamine, serine, proline, lysine, arginine, histidine, glutamic acid, cysteine, glycine, phenylalanine, alanine, isoleucine, leucine, aspartic acid, methionine, tryptophan, valine and tyrosine, with some embodiments not utilizing cysteine (due to possible disulfide formation) or proline (due to steric effects). In some embodiments, the amino acid at position 113 is substituted with serine (S). In some embodiments, the alanine (A) at position 113 is substituted with serine (S). In some embodiments, the variant amylase enzyme comprises or consists of the substitution A113S of SEQ ID NO:4.

In some embodiments, the variant amylase enzyme comprises an amino acid substitution at position 139. In some embodiments, the substitution is with any other of the 19 naturally occurring amino acids, namely threonine, asparagine, serine, glutamine, proline, lysine, arginine, histidine, glutamic acid, cysteine, glycine, phenylalanine, alanine, isoleucine, leucine, aspartic acid, methionine, tryptophan and valine, with some embodiments not utilizing cysteine (due to possible disulfide formation) or proline (due to steric effects). In some embodiments, the amino acid at position 139 is substituted with phenylalanine (F). In some embodiments, the tyrosine (Y) at position 139 is substituted with phenylalanine (F). In some embodiments, the variant amylase enzyme comprises or consists of the substitution Y139F of SEQ ID NO:4.

In some embodiments, the variant amylase enzyme comprises an amino acid substitution at position 271. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, aspartic acid, methionine, tryptophan, tyrosine, serine and valine, with some embodiments not utilizing cysteine (due to possible disulfide formation) or proline (due to steric effects). In some embodiments, the amino acid at position 271 is substituted with aspartic acid (D). In some embodiments, the glutamine (Q) at position 271 is substituted with aspartic acid (D). In some embodiments, the variant amylase enzyme comprises or consists of the substitution Q271D of SEQ ID NO:4.

In some embodiments, the variant amylase enzyme comprises an amino acid substitution at position 272. In some embodiments, the substitution is with any other of the 19 naturally occurring amino acids, namely serine, asparagine, glycine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 272 is substituted with asparagine (N) or methionine (M). In some embodiments, the threonine (T) at position 272 is substituted with asparagine (N) or methionine (M). In some embodiments, the variant amylase enzyme comprises or consists of the substitution T272N or T272M of SEQ ID NO:4.

In some embodiments, the variant amylase enzyme comprises an amino acid substitution at position 275. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 275 is substituted with lysine (K). In some embodiments, the serine (S) at position 271 is substituted with lysine (K). In some embodiments, the variant amylase enzyme comprises or consists of the substitution S275K of SEQ ID NO:4.

In some embodiments, the variant amylase enzyme comprises an amino acid substitution at position 280. In some embodiments, the substitution is with any other of the 19 naturally occurring amino acids, namely serine, threonine, asparagine, glutamine, proline, arginine, histidine, glutamic acid, cysteine, glycine, phenylalanine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 280 is substituted with glutamine (Q). In some embodiments, the lysine (K) at position 280 is substituted with glutamine (Q). In some embodiments, the variant amylase enzyme comprises or consists of the substitution K280Q of SEQ ID NO:4.

In some embodiments, the variant amylase enzyme comprises an amino acid substitution at position 306. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, leucine, glutamine, aspartic acid, methionine, tryptophan, and valine, with some embodiments not utilizing cysteine (due to possible disulfide formation) or proline (due to steric effects). In some embodiments, the amino acid at position 306 is substituted with histidine (H). In some embodiments, the tyrosine (Y) at position 306 is substituted with histidine (H). In some embodiments, the variant amylase enzyme comprises or consists of the substitution Y306H of SEQ ID NO:4.

In some embodiments, the variant amylase enzyme comprises an amino acid substitution at position 317. In some embodiments, the substitution is with any other of the 19 naturally occurring amino acids, namely serine, threonine, asparagine, lysine, proline, arginine, histidine, glutamic acid, cysteine, glycine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 317 is substituted with tyrosine (Y). In some embodiments, the phenylalanine (F) at position 317 is substituted with tyrosine (Y). In some embodiments, the variant amylase enzyme comprises or consists of the substitution F317Y of SEQ ID NO:4.

In some embodiments, the variant amylase enzyme comprises an amino acid substitution at position 338. In some embodiments, the substitution is with any other of the 19 naturally occurring amino acids, namely serine, threonine, asparagine, lysine, proline, arginine, histidine, glutamic acid, cysteine, leucine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 338 is substituted with aspartic acid (D). In some embodiments, the glycine (G) at position 338 is substituted with aspartic acid (D). In some embodiments, the variant amylase enzyme comprises or consists of the substitution G338D of SEQ ID NO:4.

In some embodiments, the variant amylase enzyme comprises an amino acid substitution at position 344. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, leucine, glutamine, aspartic acid, methionine, tryptophan, and tyrosine, with some embodiments not utilizing cysteine (due to possible disulfide formation) or proline (due to steric effects). In some embodiments, the amino acid at position 344 is substituted with leucine (L). In some embodiments, the valine (V) at position 344 is substituted with leucine (L). In some embodiments, the variant amylase enzyme comprises or consists of the substitution V344L of SEQ ID NO:4.

In some embodiments, the variant amylase enzyme comprises an amino acid substitution at position 351. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 351 is substituted with tyrosine (Y). In some embodiments, the leucine (L) at position 351 is substituted with tyrosine (Y). In some embodiments, the variant amylase enzyme comprises or consists of the substitution L351Y of SEQ ID NO:4.

In some embodiments, the variant amylase enzyme comprises an amino acid substitution at position 383. In some embodiments, the substitution is with any other of the 19 naturally occurring amino acids, namely serine, threonine, asparagine, proline, arginine, histidine, glutamic acid, cysteine, leucine, phenylalanine, glycine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 383 is substituted with asparagine (N). In some embodiments, the lysine (K) at position 383 is substituted with asparagine (N). In some embodiments, the variant amylase enzyme comprises or consists of the substitution K383N of SEQ ID NO:4.

In some embodiments, the variant amylase enzyme comprises an amino acid substitution at position 384. In some embodiments, the substitution is with any other of the 19 naturally occurring amino acids, namely serine, threonine, asparagine, proline, arginine, histidine, glutamic acid, cysteine, leucine, lysine, glycine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 384 is substituted with tryptophan (W). In some embodiments, the phenylalanine (F) at position 384 is substituted with tryptophan (W). In some embodiments, the variant amylase enzyme comprises or consists of the substitution F384W of SEQ ID NO:4.

In some embodiments, the variant amylase enzyme comprises an amino acid substitution at position 396. In some embodiments, the substitution is with any other of the 19 naturally occurring amino acids, namely serine, threonine, asparagine, proline, arginine, histidine, glutamic acid, cysteine, lysine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 396 is substituted with serine (S). In some embodiments, the leucine (L) at position 396 is substituted with serine (S). In some embodiments, the variant amylase enzyme comprises or consists of the substitution L396S of SEQ ID NO:4.

In some embodiments, the variant amylase enzyme comprises the variants selected from the group consisting of: Y67L, D19K, F83L, V107I/Q271D/F317Y/K383N, S275K/K383N, Y139F/K383N, V107I/Y306H/K383N, V107I/Y139F/Q271D/K383N, V107I/Y306H, V107I, Y306H/K383N, L351Y/K383N, Y306H, V107I/Y139F, S275K, Y139F, Y139F/Y306H, Y139F/S275K, F317Y, V107I/K383N, K383N, A113S/V344L/F384W, K280Q/V344L/L396S, T272N/V344L, A113S, G338D/F384W, A113S/V344L, F384W/L396S, L396S and T272M and are at least 90%, 95%, 96%, 97%, 98% or 99% identical to SEQ ID NO:4.

In some embodiments, the variant amylase enzyme comprises the amino acid substitution of D19K as compared to SEQ ID NO:4. In some embodiments, the variant amylase enzyme comprises the amino acid substitution of D19K, and are at least 90%, 95%, 96%, 97%, 98% or 99% identical to SEQ ID NO:4.

In some embodiments, the variant amylase enzyme comprises the amino acid substitutions of V107I/Y306H/K383N as compared to SEQ ID NO:4. In some embodiments, the variant amylase enzyme comprises the amino acid substitutions of V107I/Y306H/K383N, and are at least 90%, 95%, 96%, 97%, 98% or 99% identical to SEQ ID NO:4.

E. Specific Variants of SEQ ID NO:5

In some embodiments, the variant amylase enzymes comprise one or more (e.g., several) substitutions selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme of SEQ ID NO:5.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:5, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme. In some cases, the variant enzyme can comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions at these positions.

In some embodiments, the variant amylase enzyme comprises an amino acid substitution at position 19. In some embodiments, the substitution is with any other of the 19 naturally occurring amino acids, namely serine, threonine, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 19 is substituted with alanine (A) or aspartic acid (D). In some embodiments, the glutamic acid (E) at position 19 is substituted with alanine (A) or aspartic acid (D). In some embodiments, the variant amylase enzyme comprises or consists of the substitution E19A or E19D of SEQ ID NO:5.

In some embodiments, the variant amylase enzyme comprises an amino acid substitution at position 22. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 22 is substituted with alanine (A). In some embodiments, the isoleucine (I) at position 22 is substituted with alanine (A). In some embodiments, the variant amylase enzyme comprises or consists of the substitution I22A of SEQ ID NO:5.

In some embodiments, the variant amylase enzyme comprises an amino acid substitution at position 71. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, and valine with some embodiments not utilizing cysteine (due to possible disulfide formation) or proline (due to steric effects). In some embodiments, the amino acid at position 71 is substituted with tryptophan (W). In some embodiments, the tyrosine (Y) at position 71 is substituted with tryptophan (W). In some embodiments, the variant amylase enzyme comprises or consists of the substitution Y71W of SEQ ID NO:5.

In some embodiments, the variant amylase enzyme comprises an amino acid substitution at position 130. In some embodiments, the substitution is with any other of the 19 naturally occurring amino acids, namely serine, threonine, asparagine, glutamine, glutamic acid, aspartic acid, arginine, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 130 is substituted with arginine (R). In some embodiments, the lysine (K) at position 130 is substituted with arginine (R). In some embodiments, the variant amylase enzyme comprises or consists of the substitution K130R of SEQ ID NO:5.

In some embodiments, the variant amylase enzyme comprises an amino acid substitution at position 165. In some embodiments, the substitution is with any other of the 19 naturally occurring amino acids, namely serine, threonine, asparagine, glutamine, lysine, arginine, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 165 is substituted with asparagine (N) or arginine (R). In some embodiments, the aspartic acid (D) at position 165 is substituted with asparagine (N) or arginine (R). In some embodiments, the variant amylase enzyme comprises or consists of the substitution D165N or D165R of SEQ ID NO:5.

In some embodiments, the variant amylase enzyme comprises an amino acid substitution at position 233. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 233 is substituted with histidine (H). In some embodiments, the arginine (R) at position 233 is substituted with histidine (H). In some embodiments, the variant amylase enzyme comprises or consists of the substitution R233H of SEQ ID NO:5.

In some embodiments, the variant amylase enzyme comprises an amino acid substitution at position 266. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing proline (due to steric effects). In some embodiments, the amino acid at position 266 is substituted with threonine (T) or cysteine (C). In some embodiments, the asparagine (N) at position 266 is substituted with threonine (T) or cysteine (C). In some embodiments, the variant amylase enzyme comprises or consists of the substitution N266T or N266C of SEQ ID NO:5.

In some embodiments, the variant amylase enzyme comprises an amino acid substitution at position 394. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid methionine, proline, phenylalanine, tryptophan, valine and tyrosine with some embodiments not utilizing cysteine (due to possible disulfide formation). In some embodiments, the amino acid at position 394 is substituted with asparagine (N), threonine (T) or proline (P). In some embodiments, the glycine (G) at position 394 is substituted with asparagine (N), threonine (T) or proline (P). In some embodiments, the variant amylase enzyme comprises or consists of the substitution G394N, G394T or G394P of SEQ ID NO:5.

In some embodiments, the variant amylase enzyme comprises an amino acid substitution at position 417. In some embodiments, the substitution is with any other of the 19 naturally occurring amino acids, namely serine, threonine, asparagine, glutamine, lysine, glutamic acid, aspartic acid, histidine, cysteine, glycine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 417 is substituted with glycine (G). In some embodiments, the alanine (A) at position 417 is substituted with glycine (G). In some embodiments, the variant amylase enzyme comprises or consists of the substitution A417G of SEQ ID NO:5.

In some embodiments, the variant amylase enzyme comprises an amino acid substitution at position 420. In some embodiments, the substitution is with any other of the 19 naturally occurring amino acids, namely serine, threonine, glutamine, lysine, arginine, asparagine, aspartic acid, histidine, cysteine, glycine, alanine, isoleucine, leucine, glutamic acid methionine, proline, phenylalanine, tryptophan, and valine, with some embodiments not utilizing cysteine (due to possible disulfide formation) or proline (due to steric effects). In some embodiments, the amino acid at position 420 is substituted with threonine (T) or leucine (L). In some embodiments, the tyrosine (Y) at position 420 is substituted with threonine (T) or leucine (L). In some embodiments, the variant amylase enzyme comprises or consists of the substitution Y420T or Y420L of SEQ ID NO:5.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:5.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F), asparagine (N) or serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S of SEQ ID NO:5.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:5.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:5.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:5.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing proline (due to steric effects). In some embodiments, the amino acid at position 377 is substituted with glutamine (Q), histidine (H) or cysteine (C). In some embodiments, the tyrosine (Y) at position 377 is substituted with glutamine (Q), histidine (H) or cysteine (C). In some embodiments, the variant amylase enzyme comprises or consists of the substitution Y377Q, Y377H or Y377C of SEQ ID NO:5.

In some embodiments, the variant amylase enzyme comprises an amino acid substitution at position 35. In some embodiments, the substitution is with any other of the 19 naturally occurring amino acids, namely serine, threonine, asparagine, glutamine, isoleucine, aspartic acid, lysine, arginine, histidine, cysteine, glycine, leucine, methionine, glutamic acid, proline, phenylalanine, tryptophan, valine and tyrosine with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V of SEQ ID NO:5.

In some embodiments, the variant amylase enzyme comprises an amino acid substitution at position 75. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S of SEQ ID NO:5.

In some embodiments, the variant amylase enzyme comprises an amino acid substitution at position 182. In some embodiments, the substitution is with any other of the 19 naturally occurring amino acids, namely serine, threonine, asparagine, glutamine, aspartic acid, lysine, arginine, histidine, cysteine, glycine, leucine, methionine, isoleucine, glutamic acid, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W of SEQ ID NO:5.

In some embodiments, the variant amylase enzyme comprises an amino acid substitution at position 187. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, isoleucine, glutamic acid, proline, phenylalanine, tryptophan and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I of SEQ ID NO:5.

In some embodiments, the variant amylase enzyme comprises an amino acid substitution at position 232. In some embodiments, the substitution is with any other of the 19 naturally occurring amino acids, namely serine, threonine, asparagine, valine, glutamine, aspartic acid, lysine, arginine, histidine, cysteine, glycine, alanine, leucine, methionine, glutamic acid, proline, phenylalanine, tryptophan and tyrosine, with some embodiments not utilizing cysteine (due to possible disulfide formation) or proline (due to steric effects) . In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K of SEQ ID NO:5.

In some embodiments, the variant amylase enzyme comprises an amino acid substitution at position 271. In some embodiments, the substitution is with any other of the 19 naturally occurring amino acids, namely serine, threonine, alanine, asparagine, serine, glutamine, lysine, arginine, glutamic acid, histidine, cysteine, aspartic acid, glycine, isoleucine, leucine, methionine, proline, phenylalanine, tryptophan and tyrosine with some embodiments not utilizing cysteine (due to possible disulfide formation) or proline (due to steric effects). In some embodiments, the amino acid at position 271 is substituted with methionine (M) or serine (S). In some embodiments, the valine (V) at position 271 is substituted with methionine (M) or serine (S). In some embodiments, the variant amylase enzyme comprises or consists of the substitution V271M or V271S of SEQ ID NO:5.

In some embodiments, the variant amylase enzyme comprises an amino acid substitution at position 351. In some embodiments, the substitution is with any other of the 19 naturally occurring amino acids, namely serine, threonine, asparagine, glutamine, aspartic acid, lysine, arginine, histidine, cysteine, glycine, isoleucine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T of SEQ ID NO:5.

In some embodiments, the variant amylase enzyme comprises an amino acid substitution at position 372. In some embodiments, the substitution is with any other of the 19 naturally occurring amino acids, namely serine, threonine, asparagine, glutamine, glutamic acid, aspartic acid, lysine, arginine, histidine, cysteine, glycine, tyrosine, isoleucine, leucine, methionine, proline, phenylalanine, tryptophan, and valine with some embodiments not utilizing cysteine (due to possible disulfide formation). In some embodiments, the amino acid at position 372 is substituted with serine (S) or proline (P). In some embodiments, the alanine (A) at position 372 is substituted with serine (S) or proline (P). In some embodiments, the variant amylase enzyme comprises or consists of the substitution A372S or A372P of SEQ ID NO:5.

In some embodiments, the variant amylase enzyme comprises an amino acid substitution at position 378. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, arginine, methionine, proline, phenylalanine, tryptophan and tyrosine with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C of SEQ ID NO:5.

In some embodiments, the variant amylase enzyme comprises an amino acid substitution at position 384. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T of SEQ ID NO:5.

In some embodiments, the variant amylase enzyme comprises an amino acid substitution at position 392. In some embodiments, the substitution is with any other of the 19 naturally occurring amino acids, namely threonine, glutamine, lysine, serine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K of SEQ ID NO:5.

In some embodiments, the variant amylase enzyme comprises an amino acid substitution at position 393. In some embodiments, the substitution is with any other of the 19 naturally occurring amino acids, namely serine, threonine, asparagine, glutamine, lysine, aspartic acid, arginine, histidine, cysteine, glycine, alanine, isoleucine, glutamic acid methionine, proline, phenylalanine, tryptophan, valine and tyrosine, with some embodiments not utilizing cysteine (due to possible disulfide formation). In some embodiments, the amino acid at position 393 is substituted with asparagine (N), lysine (K), arginine (R), glutamine (Q), proline (P), serine (S), alanine (A) or glutamic acid (E). In some embodiments, the leucine (L) at position 393 is substituted with asparagine (N), lysine (K), arginine (R), glutamine (Q), proline (P), serine (S), alanine (A) or glutamic acid (E). In some embodiments, the variant amylase enzyme comprises or consists of the substitution L393N, L393K, L393R, L393Q, L393P, L393S, L393A or L393E of SEQ ID NO:5.

In some embodiments, the variant amylase enzyme comprises an amino acid substitution at position 395. In some embodiments, the substitution is with any other of the 19 naturally occurring amino acids, namely threonine, glutamine, lysine, serine, glutamic acid, aspartic acid, histidine, cysteine, alanine, isoleucine, leucine, arginine, asparagine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E of SEQ ID NO:5.

F. Specific Variants of SEQ ID NO:6

In some embodiments, the variant amylase enzymes comprise one or more (e.g., several) substitutions selected from the group consisting of P18T, E19A, E19D, I22A, A35V, G54F, G54N, G54S, Y71W, T75S, K130R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme of SEQ ID NO:6.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:6, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, E19A, E19D, I22A, A35V, G54F, G54N, G54S, Y71W, T75S, K130R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme. In some cases, the variant enzyme can comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions at these positions.

In some embodiments, the variant amylase enzyme comprises an amino acid substitution at position 19. In some embodiments, the substitution is with any other of the 19 naturally occurring amino acids, namely serine, threonine, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 19 is substituted with alanine (A) or aspartic acid (D). In some embodiments, the glutamic acid (E) at position 19 is substituted with alanine (A) or aspartic acid (D). In some embodiments, the variant amylase enzyme comprises or consists of the substitution E19A or E19D of SEQ ID NO:6.

In some embodiments, the variant amylase enzyme comprises an amino acid substitution at position 22. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 22 is substituted with alanine (A). In some embodiments, the isoleucine (I) at position 22 is substituted with alanine (A). In some embodiments, the variant amylase enzyme comprises or consists of the substitution I22A of SEQ ID NO:6.

In some embodiments, the variant amylase enzyme comprises an amino acid substitution at position 71. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, and valine with some embodiments not utilizing cysteine (due to possible disulfide formation) or proline (due to steric effects). In some embodiments, the amino acid at position 71 is substituted with tryptophan (W). In some embodiments, the tyrosine (Y) at position 71 is substituted with tryptophan (W). In some embodiments, the variant amylase enzyme comprises or consists of the substitution Y71W of SEQ ID NO:6.

In some embodiments, the variant amylase enzyme comprises an amino acid substitution at position 130. In some embodiments, the substitution is with any other of the 19 naturally occurring amino acids, namely serine, threonine, asparagine, glutamine, glutamic acid, aspartic acid, arginine, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 130 is substituted with arginine (R). In some embodiments, the lysine (K) at position 130 is substituted with arginine (R). In some embodiments, the variant amylase enzyme comprises or consists of the substitution K130R of SEQ ID NO:6.

In some embodiments, the variant amylase enzyme comprises an amino acid substitution at position 233. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 233 is substituted with histidine (H). In some embodiments, the arginine (R) at position 233 is substituted with histidine (H). In some embodiments, the variant amylase enzyme comprises or consists of the substitution R233H of SEQ ID NO:6.

In some embodiments, the variant amylase enzyme comprises an amino acid substitution at position 266. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing proline (due to steric effects). In some embodiments, the amino acid at position 266 is substituted with threonine (T) or cysteine (C). In some embodiments, the asparagine (N) at position 266 is substituted with threonine (T) or cysteine (C). In some embodiments, the variant amylase enzyme comprises or consists of the substitution N266T or N266C of SEQ ID NO:6.

In some embodiments, the variant amylase enzyme comprises an amino acid substitution at position 325. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine. In some embodiments, the amino acid at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the asparagine (N) at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the variant amylase enzyme comprises or consists of the substitution N325Y, N325V, N325A, N325L, N325G, N325C, N325K, N325S, N325T, N325R, N325M, N325F, N325H, N325P or N325L of SEQ ID NO:6.

In some embodiments, the variant amylase enzyme comprises an amino acid substitution at position 394. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid methionine, proline, phenylalanine, tryptophan, valine and tyrosine, with some embodiments not utilizing cysteine (due to possible disulfide formation). In some embodiments, the amino acid at position 394 is substituted with asparagine (N), threonine (T) or proline (P). In some embodiments, the glycine (G) at position 394 is substituted with asparagine (N), threonine (T) or proline (P). In some embodiments, the variant amylase enzyme comprises or consists of the substitution G394N, G394T or G394P of SEQ ID NO:6.

In some embodiments, the variant amylase enzyme comprises an amino acid substitution at position 417. In some embodiments, the substitution is with any other of the 19 naturally occurring amino acids, namely serine, threonine, asparagine, glutamine, lysine, glutamic acid, aspartic acid, histidine, cysteine, glycine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 417 is substituted with glycine (G). In some embodiments, the alanine (A) at position 417 is substituted with glycine (G). In some embodiments, the variant amylase enzyme comprises or consists of the substitution A417G of SEQ ID NO:6.

In some embodiments, the variant amylase enzyme comprises an amino acid substitution at position 420. In some embodiments, the substitution is with any other of the 19 naturally occurring amino acids, namely serine, threonine, glutamine, lysine, arginine, asparagine, aspartic acid, histidine, cysteine, glycine, alanine, isoleucine, leucine, glutamic acid methionine, proline, phenylalanine, tryptophan, and valine, with some embodiments not utilizing cysteine (due to possible disulfide formation) or proline (due to steric effects). In some embodiments, the amino acid at position 420 is substituted with threonine (T) or leucine (L). In some embodiments, the amino acid at position 420 is substituted with threonine (T) or leucine (L). In some embodiments, the tyrosine (Y) at position 420 is substituted with threonine (T) or leucine (L). In some embodiments, the variant amylase enzyme comprises or consists of the substitution Y420T or Y420L of SEQ ID NO:6.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:6.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F), asparagine (N) or serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S of SEQ ID NO:6.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:6.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:6.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:6.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing proline (due to steric effects). In some embodiments, the amino acid at position 377 is substituted with glutamine (Q), histidine (H)

or cysteine (C). In some embodiments, the tyrosine (Y) at position 377 is substituted with glutamine (Q), histidine (H) or cysteine (C). In some embodiments, the variant amylase enzyme comprises or consists of the substitution Y377Q, Y377H or Y377C of SEQ ID NO:6.

In some embodiments, the variant amylase enzyme comprises an amino acid substitution at position 35. In some embodiments, the substitution is with any other of the 19 naturally occurring amino acids, namely serine, threonine, asparagine, glutamine, isoleucine, aspartic acid, lysine, arginine, histidine, cysteine, glycine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V of SEQ ID NO:6.

In some embodiments, the variant amylase enzyme comprises an amino acid substitution at position 75. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S of SEQ ID NO:6.

In some embodiments, the variant amylase enzyme comprises an amino acid substitution at position 182. In some embodiments, the substitution is with any other of the 19 naturally occurring amino acids, namely serine, threonine, asparagine, glutamine, aspartic acid, lysine, arginine, histidine, cysteine, glycine, leucine, methionine, isoleucine, glutamic acid, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W of SEQ ID NO:6.

In some embodiments, the variant amylase enzyme comprises an amino acid substitution at position 187. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, isoleucine, glutamic acid, proline, phenylalanine, tryptophan and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I of SEQ ID NO:6.

In some embodiments, the variant amylase enzyme comprises an amino acid substitution at position 232. In some embodiments, the substitution is with any other of the 19 naturally occurring amino acids, namely serine, threonine, asparagine, valine, glutamine, aspartic acid, lysine, arginine, histidine, cysteine, glycine, alanine, leucine, methionine, glutamic acid, proline, phenylalanine, tryptophan and tyrosine, with some embodiments not utilizing cysteine (due to possible disulfide formation) or proline (due to steric effects). In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K of SEQ ID NO:6.

In some embodiments, the variant amylase enzyme comprises an amino acid substitution at position 271. In some embodiments, the substitution is with any other of the 19 naturally occurring amino acids, namely serine, threonine, alanine, asparagine, serine, glutamine, lysine, arginine, glutamic acid, histidine, cysteine, aspartic acid, glycine, isoleucine, leucine, methionine, proline, phenylalanine, tryptophan and tyrosine with some embodiments not utilizing cysteine (due to possible disulfide formation) or proline (due to steric effects). In some embodiments, the amino acid at position 271 is substituted with methionine (M) or serine (S). In some embodiments, the valine (V) at position 271 is substituted with methionine (M) or serine (S). In some embodiments, the variant amylase enzyme comprises or consists of the substitution V271M or V271S of SEQ ID NO:6.

In some embodiments, the variant amylase enzyme comprises an amino acid substitution at position 351. In some embodiments, the substitution is with any other of the 19 naturally occurring amino acids, namely serine, threonine, asparagine, glutamine, aspartic acid, lysine, arginine, histidine, cysteine, glycine, isoleucine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T of SEQ ID NO:6.

In some embodiments, the variant amylase enzyme comprises an amino acid substitution at position 372. In some embodiments, the substitution is with any other of the 19 naturally occurring amino acids, namely serine, threonine, asparagine, glutamine, glutamic acid, aspartic acid, lysine, arginine, histidine, cysteine, glycine, tyrosine, isoleucine, leucine, methionine, proline, phenylalanine, tryptophan, and valine with some embodiments not utilizing cysteine (due to possible disulfide formation). In some embodiments, the amino acid at position 372 is substituted with serine (S) or proline (P). In some embodiments, the alanine (A) at position 372 is substituted with serine (S) or proline (P). In some embodiments, the variant amylase enzyme comprises or consists of the substitution A372S or A372P of SEQ ID NO:6.

In some embodiments, the variant amylase enzyme comprises an amino acid substitution at position 378. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, arginine, methionine, proline, phenylalanine, tryptophan and tyrosine with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C of SEQ ID NO:6.

In some embodiments, the variant amylase enzyme comprises an amino acid substitution at position 384. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T of SEQ ID NO:6.

In some embodiments, the variant amylase enzyme comprises an amino acid substitution at position 392. In some embodiments, the substitution is with any other of the 19 naturally occurring amino acids, namely threonine, glutamine, lysine, serine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K of SEQ ID NO:6.

In some embodiments, the variant amylase enzyme comprises an amino acid substitution at position 393. In some embodiments, the substitution is with any other of the 19 naturally occurring amino acids, namely serine, threonine, asparagine, glutamine, lysine, aspartic acid, arginine, histidine, cysteine, glycine, alanine, isoleucine, glutamic acid methionine, proline, phenylalanine, tryptophan, valine and tyrosine, with some embodiments not utilizing cysteine (due to possible disulfide formation). In some embodiments, the amino acid at position 393 is substituted with asparagine (N), lysine (K), arginine (R), glutamine (Q), proline (P), serine (S), alanine (A) or glutamic acid (E). In some embodiments, the leucine (L) at position 393 is substituted with asparagine (N), lysine (K), arginine (R), glutamine (Q), proline (P), serine (S), alanine (A) or glutamic acid (E). In some embodiments, the variant amylase enzyme comprises or consists of the substitution L393N, L393K, L393R, L393Q, L393P, L393S, L393A or L393E of SEQ ID NO:6.

In some embodiments, the variant amylase enzyme comprises an amino acid substitution at position 395. In some embodiments, the substitution is with any other of the 19 naturally occurring amino acids, namely threonine, glutamine, lysine, serine, glutamic acid, aspartic acid, histidine, cysteine, alanine, isoleucine, leucine, arginine, asparagine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E of SEQ ID NO:6.

G. Specific Variants of SEQ ID NO:7

In some embodiments, the variant amylase enzymes comprise one or more (e.g., several) substitutions selected from the group consisting of P18T, E19A, E19D, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme of SEQ ID NO:7.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:7, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, E19A, E19D, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, A417G, Y420T, and Y420L as compared to a parent amylase enzyme. In some cases, the variant enzyme can comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions at these positions.

In some embodiments, the variant amylase enzyme comprises an amino acid substitution at position 19. In some embodiments, the substitution is with any other of the 19 naturally occurring amino acids, namely serine, threonine, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 19 is substituted with alanine (A) or aspartic acid (D). In some embodiments, the glutamic acid (E) at position 19 is substituted with alanine (A) or aspartic acid (D). In some embodiments, the variant amylase enzyme comprises or consists of the substitution E19A or E19D of SEQ ID NO:7.

In some embodiments, the variant amylase enzyme comprises an amino acid substitution at position 71. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, and valine with some embodiments not utilizing cysteine (due to possible disulfide formation) or proline (due to steric effects). In some embodiments, the amino acid at position 71 is substituted with tryptophan (W). In some embodiments, the tyrosine (Y) at position 71 is substituted with tryptophan (W). In some embodiments, the variant amylase enzyme comprises or consists of the substitution Y71W of SEQ ID NO:7.

In some embodiments, the variant amylase enzyme comprises an amino acid substitution at position 130. In some embodiments, the substitution is with any other of the 19 naturally occurring amino acids, namely serine, threonine, asparagine, glutamine, glutamic acid, aspartic acid, arginine, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 130 is substituted with arginine (R). In some embodiments, the lysine (K) at position 130 is substituted with arginine (R). In some embodiments, the variant amylase enzyme comprises or consists of the substitution K130R of SEQ ID NO:7.

In some embodiments, the variant amylase enzyme comprises an amino acid substitution at position 165. In some embodiments, the substitution is with any other of the 19 naturally occurring amino acids, namely serine, threonine, asparagine, glutamine, lysine, arginine, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 165 is substituted with asparagine (N) or arginine (R). In some embodiments, the aspartic acid (D) at position 165 is substituted with asparagine (N) or arginine (R). In some embodiments, the variant amylase enzyme comprises or consists of the substitution D165N or D165R of SEQ ID NO:7.

In some embodiments, the variant amylase enzyme comprises an amino acid substitution at position 233. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 233 is substituted with histidine (H). In some embodiments, the arginine (R) at position 233 is substituted with histidine (H). In some embodiments, the variant amylase enzyme comprises or consists of the substitution R233H of SEQ ID NO:7.

In some embodiments, the variant amylase enzyme comprises an amino acid substitution at position 266. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing proline (due to steric effects). In some embodiments, the amino acid at position 266 is substituted with threonine (T) or cysteine (C). In some embodiments, the asparagine (N) at position 266 is substituted with threonine (T) or cysteine (C). In some embodiments, the variant amylase enzyme comprises or consists of the substitution N266T or N266C of SEQ ID NO:7.

In some embodiments, the variant amylase enzyme comprises an amino acid substitution at position 325. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine. In some embodiments, the amino acid at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the asparagine (N) at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the variant amylase enzyme comprises or consists of the substitution N325Y, N325V, N325A, N325L, N325G, N325C, N325K, N325S, N325T, N325R, N325M, N325F, N325H, N325P or N325L of SEQ ID NO:7.

In some embodiments, the variant amylase enzyme comprises an amino acid substitution at position 394. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid methionine, proline, phenylalanine, tryptophan, valine and tyrosine, with some embodiments not utilizing cysteine (due to possible disulfide formation). In some embodiments, the amino acid at position 394 is substituted with asparagine (N), threonine (T) or proline (P). In some embodiments, the glycine (G) at position 394 is substituted with asparagine (N), threonine (T) or proline (P). In some embodiments, the variant amylase enzyme comprises or consists of the substitution G394N, G394T or G394P of SEQ ID NO:7.

In some embodiments, the variant amylase enzyme comprises an amino acid substitution at position 417. In some embodiments, the substitution is with any other of the 19 naturally occurring amino acids, namely serine, threonine, asparagine, glutamine, lysine, glutamic acid, aspartic acid, histidine, cysteine, glycine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 417 is substituted with glycine (G). In some embodiments, the alanine (A) at position 417 is substituted with glycine (G). In some embodiments, the variant amylase enzyme comprises or consists of the substitution A417G of SEQ ID NO:7.

In some embodiments, the variant amylase enzyme comprises an amino acid substitution at position 420. In some embodiments, the substitution is with any other of the 19 naturally occurring amino acids, namely serine, threonine, glutamine, lysine, arginine, asparagine, aspartic acid, histidine, cysteine, glycine, alanine, isoleucine, leucine, glutamic acid methionine, proline, phenylalanine, tryptophan, and valine, with some embodiments not utilizing cysteine (due to possible disulfide formation) or proline (due to steric effects). In some embodiments, the amino acid at position 420 is substituted with threonine (T) or leucine (L). In some embodiments, the tyrosine (Y) at position 420 is substituted with threonine (T) or leucine (L). In some embodiments, the variant amylase enzyme comprises or consists of the substitution Y420T or Y420L of SEQ ID NO:7.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:7.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F), asparagine (N) or serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S of SEQ ID NO:7.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:7.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:7.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:7.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing cysteine (due to possible disulfide formation) or proline (due to steric effects). In some embodiments, the amino acid at position 377 is substituted with glutamine (Q), histidine (H) or cysteine (C). In some embodiments, the tyrosine (Y) at position 377 is substituted with glutamine (Q), histidine (H) or cysteine (C). In some embodiments, the variant amylase enzyme comprises or consists of the substitution Y377Q, Y377H or Y377C of SEQ ID NO:7.

In some embodiments, the variant amylase enzyme comprises an amino acid substitution at position 35. In some embodiments, the substitution is with any other of the 19 naturally occurring amino acids, namely serine, threonine, asparagine, glutamine, isoleucine, aspartic acid, lysine, arginine, histidine, cysteine, glycine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V of SEQ ID NO:7.

In some embodiments, the variant amylase enzyme comprises an amino acid substitution at position 75. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S of SEQ ID NO:7.

In some embodiments, the variant amylase enzyme comprises an amino acid substitution at position 182. In some embodiments, the substitution is with any other of the 19 naturally occurring amino acids, namely serine, threonine, asparagine, glutamine, aspartic acid, lysine, arginine, histidine, cysteine, glycine, leucine, methionine, isoleucine, glutamic acid, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W of SEQ ID NO:7.

In some embodiments, the variant amylase enzyme comprises an amino acid substitution at position 187. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, isoleucine, glutamic acid, proline, phenylalanine, tryptophan and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I of SEQ ID NO:7.

In some embodiments, the variant amylase enzyme comprises an amino acid substitution at position 232. In some embodiments, the substitution is with any other of the 19 naturally occurring amino acids, namely serine, threonine, asparagine, valine, glutamine, aspartic acid, lysine, arginine, histidine, cysteine, glycine, alanine, leucine, methionine, glutamic acid, proline, phenylalanine, tryptophan and tyrosine, with some embodiments not utilizing cysteine (due to possible disulfide formation) or proline (due to steric effects). In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K of SEQ ID NO:7.

In some embodiments, the variant amylase enzyme comprises an amino acid substitution at position 271. In some embodiments, the substitution is with any other of the 19 naturally occurring amino acids, namely serine, threonine, alanine, asparagine, serine, glutamine, lysine, arginine, glutamic acid, histidine, cysteine, aspartic acid, glycine, isoleucine, leucine, methionine, proline, phenylalanine, tryptophan and tyrosine with some embodiments not utilizing cysteine (due to possible disulfide formation) or proline (due to steric effects). In some embodiments, the amino acid at position 271 is substituted with methionine (M) or serine (S). In some embodiments, the valine (V) at position 271 is substituted with methionine (M) or serine (S). In some embodiments, the variant amylase enzyme comprises or consists of the substitution V271M or V271S of SEQ ID NO:7.

In some embodiments, the variant amylase enzyme comprises an amino acid substitution at position 351. In some embodiments, the substitution is with any other of the 19 naturally occurring amino acids, namely serine, threonine, asparagine, glutamine, aspartic acid, lysine, arginine, histidine, cysteine, glycine, isoleucine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T of SEQ ID NO:7.

In some embodiments, the variant amylase enzyme comprises an amino acid substitution at position 372. In some embodiments, the substitution is with any other of the 19 naturally occurring amino acids, namely serine, threonine, asparagine, glutamine, glutamic acid, aspartic acid, lysine, arginine, histidine, cysteine, glycine, tyrosine, isoleucine, leucine, methionine, proline, phenylalanine, tryptophan, and valine with some embodiments not utilizing cysteine (due to possible disulfide formation). In some embodiments, the amino acid at position 372 is substituted with serine (S) or proline (P). In some embodiments, the alanine (A) at position 372 is substituted with serine (S) or proline (P). In some embodiments, the variant amylase enzyme comprises or consists of the substitution A372S or A372P of SEQ ID NO:7.

In some embodiments, the variant amylase enzyme comprises an amino acid substitution at position 378. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, arginine, methionine, proline, phenylalanine, tryptophan and tyrosine with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C of SEQ ID NO:7.

In some embodiments, the variant amylase enzyme comprises an amino acid substitution at position 384. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T of SEQ ID NO:7.

In some embodiments, the variant amylase enzyme comprises an amino acid substitution at position 392. In some embodiments, the substitution is with any other of the 19 naturally occurring amino acids, namely threonine, glutamine, lysine, serine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K of SEQ ID NO:7.

In some embodiments, the variant amylase enzyme comprises an amino acid substitution at position 393. In some embodiments, the substitution is with any other of the 19 naturally occurring amino acids, namely serine, threonine, asparagine, glutamine, lysine, aspartic acid, arginine, histidine, cysteine, glycine, alanine, isoleucine, glutamic acid methionine, proline, phenylalanine, tryptophan, valine and tyrosine, with some embodiments not utilizing cysteine (due to possible disulfide formation). In some embodiments, the amino acid at position 393 is substituted with asparagine (N), lysine (K), arginine (R), glutamine (Q), proline (P), serine (S), alanine (A) or glutamic acid (E). In some embodiments, the leucine (L) at position 393 is substituted with asparagine (N), lysine (K), arginine (R), glutamine (Q), proline (P), serine (S), alanine (A) or glutamic acid (E). In some embodiments, the variant amylase enzyme comprises or consists of the substitution L393N, L393K, L393R, L393Q, L393P, L393S, L393A or L393E of SEQ ID NO:7.

In some embodiments, the variant amylase enzyme comprises an amino acid substitution at position 395. In some embodiments, the substitution is with any other of the 19 naturally occurring amino acids, namely threonine, glutamine, lysine, serine, glutamic acid, aspartic acid, histidine, cysteine, alanine, isoleucine, leucine, arginine, asparagine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E of SEQ ID NO:7.

H. Specific Variants of SEQ ID NO:8

In some embodiments, the variant amylase enzymes comprise one or more (e.g., several) substitutions selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E and A417G as compared to a parent amylase enzyme of SEQ ID NO:8.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:8, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of P18T, E19A, E19D, I22A, A35V, G54F, G54N, G54S, Y71W, T75S, K130R, D165N, D165R, A175N, A182W, V187I, I232K, R233H, S262R, N266T, N266C, V271M, V271S, D321T, N325A, N325C, N325F, N325G, N325H, N325K, N325L, N325M, N325P, N325R, N325S, N325T, N325V, N325Y, V351T, A372S, A372P, Y377C, Y377H, Y377Q, V378C, S384T, N392K, L393N, L393K, L393R, L393Q, L393P, L393S, L393A, L393E, G394N, G394T, G394P, G395E, and A417G as compared to a parent amylase enzyme. In some cases, the variant enzyme can comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions at these positions.

In some embodiments, the variant amylase enzyme comprises an amino acid substitution at position 19. In some embodiments, the substitution is with any other of the 19 naturally occurring amino acids, namely serine, threonine, asparagine, glutamine, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 19 is substituted with alanine (A) or aspartic acid (D). In some embodiments, the glutamic acid (E) at position 19 is substituted with alanine (A) or aspartic acid (D). In some embodiments, the variant amylase enzyme comprises or consists of the substitution E19A or E19D of SEQ ID NO:8.

In some embodiments, the variant amylase enzyme comprises an amino acid substitution at position 22. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 22 is substituted with alanine (A). In some embodiments, the isoleucine (I) at position 22 is substituted with alanine (A). In some embodiments, the variant amylase enzyme comprises or consists of the substitution I22A of SEQ ID NO:8.

In some embodiments, the variant amylase enzyme comprises an amino acid substitution at position 71. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, and valine with some embodiments not utilizing cysteine (due to possible disulfide formation) or proline (due to steric effects). In some embodiments, the amino acid at position 71 is substituted with tryptophan (W). In some embodiments, the tyrosine (Y) at position 71 is substituted with tryptophan (W). In some embodiments, the variant amylase enzyme comprises or consists of the substitution Y71W of SEQ ID NO:8.

In some embodiments, the variant amylase enzyme comprises an amino acid substitution at position 130. In some embodiments, the substitution is with any other of the 19 naturally occurring amino acids, namely serine, threonine, asparagine, glutamine, glutamic acid, aspartic acid, arginine, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 130 is substituted with arginine (R). In some embodiments, the lysine (K) at position 130 is substituted with arginine (R). In some embodiments, the variant amylase enzyme comprises or consists of the substitution K130R of SEQ ID NO:8.

In some embodiments, the variant amylase enzyme comprises an amino acid substitution at position 165. In some embodiments, the substitution is with any other of the 19 naturally occurring amino acids, namely serine, threonine, asparagine, glutamine, lysine, arginine, histidine, cysteine, glycine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 165 is substituted with asparagine (N) or arginine (R). In some embodiments, the aspartic acid (D) at position 165 is substituted with asparagine (N) or arginine (R). In some embodiments, the variant amylase enzyme comprises or consists of the substitution D165N or D165R of SEQ ID NO:8.

In some embodiments, the variant amylase enzyme comprises an amino acid substitution at position 233. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 233 is substituted with histidine (H). In some embodiments, the arginine (R) at position 233 is substituted with histidine (H). In some embodiments, the variant amylase enzyme comprises or consists of the substitution R233H of SEQ ID NO:8.

In some embodiments, the variant amylase enzyme comprises an amino acid substitution at position 266. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine, with some embodiments not utilizing proline (due to steric effects). In some embodiments, the amino acid at position 266 is substituted with threonine (T) or cysteine (C). In some embodiments, the asparagine (N) at position 266 is substituted with threonine (T) or cysteine (C). In some embodiments, the variant amylase enzyme comprises or consists of the substitution N266T or N266C of SEQ ID NO:8.

In some embodiments, the variant amylase enzyme comprises an amino acid substitution at position 325. In some embodiments, the substitution is with any other of the 19 naturally occurring amino acids, namely serine, threonine, glutamine, lysine, arginine, aspartic acid, histidine, cysteine, glycine, alanine, isoleucine, leucine, glutamic acid methionine, proline, phenylalanine, tryptophan, valine and tyrosine. In some embodiments, the amino acid at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the asparagine (N) at position 325 is substituted with tyrosine (Y), valine (V), alanine (A), leucine (L), glycine (G), cysteine (C), lysine (K), serine (S), threonine (T), arginine (R), methionine (M), phenylalanine (F), histidine (H), proline (P) or leucine (L). In some embodiments, the variant amylase enzyme comprises or consists of the substitution N325Y, N325V, N325A, N325L, N325G, N325C, N325K, N325S, N325T, N325R, N325M, N325F, N325H, N325P or N325L of SEQ ID NO:8.

In some embodiments, the variant amylase enzyme comprises an amino acid substitution at position 394. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid methionine, proline, phenylalanine, tryptophan, valine and tyrosine, with some embodiments not utilizing cysteine (due to possible disulfide formation). In some embodiments, the amino acid at position 394 is substituted with asparagine (N), threonine (T) or proline (P). In some embodiments, the glycine (G) at position 394 is substituted with asparagine (N), threonine (T) or proline (P). In some embodiments, the variant amylase enzyme comprises or consists of the substitution G394N, G394T or G394P of SEQ ID NO:8.

In some embodiments, the variant amylase enzyme comprises an amino acid substitution at position 417. In some embodiments, the substitution is with any other of the 19 naturally occurring amino acids, namely serine, threonine, asparagine, glutamine, glutamic acid, aspartic acid, histidine, cysteine, glycine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 417 is substituted with glycine (G). In some embodiments, the alanine (A) at position 417 is substituted with glycine (G). In some embodiments, the variant amylase enzyme comprises or consists of the substitution A417G of SEQ ID NO:8.

In some embodiments, the variant amylase enzyme comprises an amino acid substitution at position 18. In some embodiments, the substitution is with any other of the 19 naturally occurring amino acids, namely serine, threonine, asparagine, glutamine, aspartic acid, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation). In some embodiments, the amino acid at position 18 is substituted with threonine (T). In some embodiments, the proline (P) at position 18 is substituted with threonine (T). In some embodiments, the variant amylase enzyme comprises or consists of the substitution P18T of SEQ ID NO:8.

In some embodiments, the variant amylase enzyme comprises an amino acid substitution at position 54. In some embodiments, the substitution is with any other of the 19 naturally occurring amino acids, namely serine, threonine, asparagine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 54 is substituted with phenylalanine (F), asparagine (N) or serine (S). In some embodiments, the glycine (G) at position 54 is substituted with phenylalanine (F), asparagine (N) or serine (S). In some embodiments, the variant amylase enzyme comprises or consists of the substitution G54F, G54N or G54S of SEQ ID NO:8.

In some embodiments, the variant amylase enzyme comprises an amino acid substitution at position 175. In some embodiments, the substitution is with any other of the 19 naturally occurring amino acids, namely serine, threonine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 175 is substituted with asparagine (N). In some embodiments, the alanine (A) at position 175 is substituted with asparagine (N). In some embodiments, the variant amylase enzyme comprises or consists of the substitution A175N of SEQ ID NO:8.

In some embodiments, the variant amylase enzyme comprises an amino acid substitution at position 262. In some embodiments, the substitution is with any other of the 19 naturally occurring amino acids, namely serine, threonine, alanine, asparagine, glutamine, lysine, arginine, glutamic acid, aspartic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 262 is substituted with arginine (R). In some embodiments, the serine (S) at position 262 is substituted with arginine (R). In some embodiments, the variant amylase enzyme comprises or consists of the substitution S262R of SEQ ID NO:8.

In some embodiments, the variant amylase enzyme comprises an amino acid substitution at position 321. In some embodiments, the substitution is with any other of the 19 naturally occurring amino acids, namely serine, threonine, alanine, asparagine, serine, glutamine, lysine, arginine, glutamic acid, histidine, cysteine, glycine, isoleucine, leucine, methionine, proline, phenylalanine, tryptophan, valine and tyrosine with some embodiments not utilizing cysteine (due to possible disulfide formation) or proline (due to steric effects). In some embodiments, the amino acid at position 321 is substituted with threonine (T). In some embodiments, the aspartic acid (D) at position 321 is substituted with threonine (T). In some embodiments, the variant amylase enzyme comprises or consists of the substitution D321T of SEQ ID NO:8.

In some embodiments, the variant amylase enzyme comprises an amino acid substitution at position 377. In some embodiments, the substitution is with any other of the 19 naturally occurring amino acids, namely serine, threonine, glutamine, lysine, arginine, asparagine, aspartic acid, histidine, cysteine, alanine, isoleucine, leucine, glutamic acid, glycine, methionine, proline, phenylalanine, tryptophan and valine, with some embodiments not utilizing proline (due to steric effects). In some embodiments, the amino acid at position 377 is substituted with glutamine (Q), histidine (H) or cysteine (C). In some embodiments, the tyrosine (Y) at position 377 is substituted with glutamine (Q), histidine (H) or cysteine (C). In some embodiments, the variant amylase enzyme comprises or consists of the substitution Y377Q, Y377H or Y377C of SEQ ID NO:8.

In some embodiments, the variant amylase enzyme comprises an amino acid substitution at position 35. In some embodiments, the substitution is with any other of the 19 naturally occurring amino acids, namely serine, threonine, asparagine, glutamine, isoleucine, aspartic acid, lysine, arginine, histidine, cysteine, glycine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 35 is substituted with valine (V). In some embodiments, the alanine (A) at position 35 is substituted with valine (V). In some embodiments, the variant amylase enzyme comprises or consists of the substitution A35V of SEQ ID NO:8.

In some embodiments, the variant amylase enzyme comprises an amino acid substitution at position 75. In some embodiments, the substitution is with any other of the 19 naturally occurring amino acids, namely serine, threonine, asparagine, glutamine, glutamic acid, aspartic acid, lysine, arginine, histidine, cysteine, glycine, alanine, isoleucine, leucine, methionine, proline, phenylalanine, tryptophan, valine and tyrosine, with some embodiments not utilizing cysteine (due to possible disulfide formation) or proline (due to steric effects). In some embodiments, the amino acid at position 75 is substituted with serine (S). In some embodiments, the threonine (T) at position 75 is substituted with serine (S). In some embodiments, the variant amylase enzyme comprises or consists of the substitution T75S of SEQ ID NO:8.

In some embodiments, the variant amylase enzyme comprises an amino acid substitution at position 182. In some embodiments, the substitution is with any other of the 19 naturally occurring amino acids, namely serine, threonine, asparagine, glutamine, aspartic acid, lysine, arginine, histidine, cysteine, glycine, leucine, methionine, isoleucine, glutamic acid, proline, phenylalanine, tryptophan, valine and tyrosine, with some embodiments not utilizing cysteine (due to possible disulfide formation) or proline (due to steric effects). In some embodiments, the amino acid at position 182 is substituted with tryptophan (W). In some embodiments, the alanine (A) at position 182 is substituted with tryptophan (W). In some embodiments, the variant amylase enzyme comprises or consists of the substitution A182W of SEQ ID NO:8.

In some embodiments, the variant amylase enzyme comprises an amino acid substitution at position 187. In some embodiments, the substitution is with any other of the 19 naturally occurring amino acids, namely serine, threonine, asparagine, glutamine, aspartic acid, lysine, arginine, histidine, cysteine, glycine, alanine, leucine, methionine, isoleucine, glutamic acid, proline, phenylalanine, tryptophan and tyrosine, with some embodiments not utilizing cysteine (due to possible disulfide formation) or proline (due to steric effects). In some embodiments, the amino acid at position 187 is substituted with isoleucine (I). In some embodiments, the valine (V) at position 187 is substituted with isoleucine (I). In some embodiments, the variant amylase enzyme comprises or consists of the substitution V187I of SEQ ID NO:8.

In some embodiments, the variant amylase enzyme comprises an amino acid substitution at position 232. In some embodiments, the substitution is with any other of the 19 naturally occurring amino acids, namely serine, threonine, asparagine, valine, glutamine, aspartic acid, lysine, arginine, histidine, cysteine, glycine, alanine, leucine, methionine, glutamic acid, proline, phenylalanine, tryptophan and tyrosine, with some embodiments not utilizing cysteine (due to possible disulfide formation) or proline (due to steric effects). In some embodiments, the amino acid at position 232 is substituted with lysine (K). In some embodiments, the isoleucine (I) at position 232 is substituted with lysine (K). In some embodiments, the variant amylase enzyme comprises or consists of the substitution I232K of SEQ ID NO:8.

In some embodiments, the variant amylase enzyme comprises an amino acid substitution at position 271. In some embodiments, the substitution is with any other of the 19 naturally occurring amino acids, namely serine, threonine, alanine, asparagine, serine, glutamine, lysine, arginine, glutamic acid, histidine, cysteine, aspartic acid, glycine, isoleucine, leucine, methionine, proline, phenylalanine, tryptophan and tyrosine with some embodiments not utilizing cysteine (due to possible disulfide formation) or proline (due to steric effects). In some embodiments, the amino acid at position 271 is substituted with methionine (M) or serine (S). In some embodiments, the valine (V) at position 271 is substituted with methionine (M) or serine (S). In some embodiments, the variant amylase enzyme comprises or consists of the substitution V271M or V271S of SEQ ID NO:8.

In some embodiments, the variant amylase enzyme comprises an amino acid substitution at position 351. In some embodiments, the substitution is with any other of the 19 naturally occurring amino acids, namely serine, threonine, asparagine, glutamine, aspartic acid, lysine, arginine, histidine, cysteine, glycine, isoleucine, alanine, leucine, methionine, glutamic acid, proline, phenylalanine, tryptophan, valine and tyrosine, with some embodiments not utilizing cysteine (due to possible disulfide formation) or proline (due to steric effects). In some embodiments, the amino acid at position 351 is substituted with threonine (T). In some embodiments, the valine (V) at position 351 is substituted with threonine (T). In some embodiments, the variant amylase enzyme comprises or consists of the substitution V351T of SEQ ID NO:8.

In some embodiments, the variant amylase enzyme comprises an amino acid substitution at position 372. In some embodiments, the substitution is with any other of the 19 naturally occurring amino acids, namely serine, threonine, asparagine, glutamine, glutamic acid, aspartic acid, lysine, arginine, histidine, cysteine, glycine, tyrosine, isoleucine, leucine, methionine, proline, phenylalanine, tryptophan, and valine with some embodiments not utilizing cysteine (due to possible disulfide formation). In some embodiments, the amino acid at position 372 is substituted with serine (S) or proline (P). In some embodiments, the alanine (A) at position 372 is substituted with serine (S) or proline (P). In some embodiments, the variant amylase enzyme comprises or consists of the substitution A372S or A372P of SEQ ID NO:8.

In some embodiments, the variant amylase enzyme comprises an amino acid substitution at position 378. In some embodiments, the substitution is with any other of the 19 naturally occurring amino acids, namely serine, threonine, asparagine, glutamine, lysine, glutamic acid, aspartic acid, histidine, cysteine, glycine, alanine, isoleucine, leucine, arginine, methionine, proline, phenylalanine, tryptophan and tyrosine with some embodiments not utilizing proline (due to steric effects). In some embodiments, the amino acid at position 378 is substituted with cysteine (C). In some embodiments, the valine (V) at position 378 is substituted with cysteine (C). In some embodiments, the variant amylase enzyme comprises or consists of the substitution V378C of SEQ ID NO:8.

In some embodiments, the variant amylase enzyme comprises an amino acid substitution at position 384. In some embodiments, the substitution is with any other of the 19 naturally occurring amino acids, namely threonine, asparagine, glutamine, lysine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 384 is substituted with threonine (T). In some embodiments, the serine (S) at position 384 is substituted with threonine (T). In some embodiments, the variant amylase enzyme comprises or consists of the substitution S384T of SEQ ID NO:8.

In some embodiments, the variant amylase enzyme comprises an amino acid substitution at position 392. In some embodiments, the substitution is with any other of the 19 naturally occurring amino acids, namely threonine, glutamine, lysine, serine, glutamic acid, aspartic acid, histidine, cysteine, glycine, alanine, isoleucine, leucine, arginine, methionine, proline, phenylalanine, tryptophan, valine and tyrosine with some embodiments not utilizing cysteine (due to possible disulfide formation) or proline (due to steric effects). In some embodiments, the amino acid at position 392 is substituted with lysine (K). In some embodiments, the asparagine (N) at position 392 is substituted with lysine (K). In some embodiments, the variant amylase enzyme comprises or consists of the substitution N392K of SEQ ID NO:8.

In some embodiments, the variant amylase enzyme comprises an amino acid substitution at position 393. In some embodiments, the substitution is with any other of the 19 naturally occurring amino acids, namely serine, threonine, asparagine, glutamine, lysine, aspartic acid, arginine, histidine, cysteine, glycine, alanine, isoleucine, glutamic acid, methionine, proline, phenylalanine, tryptophan, valine and tyrosine, with some embodiments not utilizing cysteine (due to possible disulfide formation). In some embodiments, the amino acid at position 393 is substituted with asparagine (N), lysine (K), arginine (R), glutamine (Q), proline (P), serine (S), alanine (A) or glutamic acid (E). In some embodiments, the leucine (L) at position 393 is substituted with asparagine (N), lysine (K), arginine (R), glutamine (Q), proline (P), serine (S), alanine (A) or glutamic acid (E). In some embodiments, the variant amylase enzyme comprises or consists of the substitution L393N, L393K, L393R, L393Q, L393P, L393S, L393A or L393E of SEQ ID NO:8.

In some embodiments, the variant amylase enzyme comprises an amino acid substitution at position 395. In some embodiments, the substitution is with any other of the 19 naturally occurring amino acids, namely threonine, glutamine, lysine, serine, glutamic acid, aspartic acid, histidine, cysteine, alanine, isoleucine, leucine, arginine, asparagine, methionine, proline, phenylalanine, tryptophan, valine and tyrosine with some embodiments not utilizing cysteine (due to possible disulfide formation) or proline (due to steric effects). In some embodiments, the amino acid at position 395 is substituted with glutamic acid (E). In some embodiments, the glycine (G) at position 395 is substituted with glutamic acid (E). In some embodiments, the variant amylase enzyme comprises or consists of the substitution G395E of SEQ ID NO:8.

I. Specific Variants of SEQ ID NO:9

In some embodiments, the variant amylase enzymes comprise one or more (e.g., several) substitutions selected from the group consisting of D19K, Y67L, F83L, A113S, Y139F, K280Q, Q271D, S275K, T272N, T272M, F317Y, V344L, L351Y, G338D, F384W and L396S as compared to a parent amylase enzyme of SEQ ID NO:9.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:9, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of D19K, Y67L, F83L, A113S, Y139F, K280Q, Q271D, S275K, T272N, T272M, F317Y, V344L, L351Y, G338D, F384W and L396S as compared to a parent amylase enzyme. In some cases, the variant enzyme can comprise 1, 2, 3, 4, 5, 6, 7, 8, 9, 10, 11, 12, 13, 14, or 15 amino acid substitutions at these positions.

In some embodiments, the variant amylase enzyme comprises at least one amino acid substitution at position(s) selected from the group consisting of D19K, Y67L, F83L, A113S, Y139F, S275K, T272M, F317Y, L351Y, L396S, Q271D/F317Y, Y139F/Q271D, Y139F/S275K, A113S/V344L/F384W, K280Q/V344L/L396S, T272N/V344L, G338D/F384W, A113S/V344L, and F384W/L396S as compared to a SEQ ID NO:9.

In some embodiments, the variant amylase enzyme comprises an amino acid substitution at position 19. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid at position 19 is substituted with lysine (K). In some embodiments, the aspartic acid (D) at position 19 is substituted with lysine (K). In some embodiments, the variant amylase enzyme comprises or consists of the substitution D19K of SEQ ID NO:9.

In some embodiments, the variant amylase enzyme comprises an amino acid substitution at position 67. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, phenylalanine, tryptophan, and valine, with some embodiments not utilizing cysteine (due to possible disulfide formation) or proline (due to steric effects). In some embodiments, the amino acid at position 67 is substituted with leucine (L). In some embodiments, the tyrosine (Y) at position 67 is substituted with leucine (L). In some embodiments, the variant amylase enzyme comprises or consists of the substitution Y67L of SEQ ID NO:9.

In some embodiments, the variant amylase enzyme comprises an amino acid substitution at position 83. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 83 is substituted with leucine (L). In some embodiments, the phenylalanine (F) at position 83 is substituted with leucine (L). In some embodiments, the variant amylase enzyme comprises or consists of the substitution F83L of SEQ ID NO:9.

In some embodiments, the variant amylase enzyme comprises an amino acid substitution at position 113. In some embodiments, the substitution is with any other of the 19 naturally occurring amino acids, namely threonine, asparagine, glutamine, serine, proline, lysine, arginine, histidine, glutamic acid, cysteine, glycine, phenylalanine, alanine, isoleucine, leucine, aspartic acid, methionine, tryptophan, valine and tyrosine, with some embodiments not utilizing cysteine (due to possible disulfide formation) or proline (due to steric effects). In some embodiments, the amino acid at position 113 is substituted with serine (S). In some embodiments, the alanine (A) at position 113 is substituted with serine (S). In some embodiments, the variant amylase enzyme comprises or consists of the substitution A113S of SEQ ID NO:9.

In some embodiments, the variant amylase enzyme comprises an amino acid substitution at position 139. In some embodiments, the substitution is with any other of the 19 naturally occurring amino acids, namely threonine, asparagine, serine, glutamine, proline, lysine, arginine, histidine, glutamic acid, cysteine, glycine, phenylalanine, alanine, isoleucine, leucine, aspartic acid, methionine, tryptophan and valine, with some embodiments not utilizing cysteine (due to possible disulfide formation) or proline (due to steric effects). In some embodiments, the amino acid at position 139 is substituted with phenylalanine (F). In some embodiments, the tyrosine (Y) at position 139 is substituted with phenylalanine (F). In some embodiments, the variant amylase enzyme comprises or consists of the substitution Y139F of SEQ ID NO:9.

In some embodiments, the variant amylase enzyme comprises an amino acid substitution at position 271. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, aspartic acid, methionine, tryptophan, tyrosine, serine and valine, with some embodiments not utilizing cysteine (due to possible disulfide formation) or proline (due to steric effects). In some embodiments, the amino acid at position 271 is substituted with aspartic acid (D). In some embodiments, the glutamine (Q) at position 271 is substituted with aspartic acid (D). In some embodiments, the variant amylase enzyme comprises or consists of the substitution Q271D of SEQ ID NO:9.

In some embodiments, the variant amylase enzyme comprises an amino acid substitution at position 272. In some embodiments, the substitution is with any other of the 19 naturally occurring amino acids, namely serine, asparagine, glycine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 272 is substituted with asparagine (N) or methionine (M). In some embodiments, the threonine (T) at position 272 is substituted with asparagine (N) or methionine (M). In some embodiments, the variant amylase enzyme comprises or consists of the substitution T272N or T272M of SEQ ID NO:9.

In some embodiments, the variant amylase enzyme comprises an amino acid substitution at position 275. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 275 is substituted with lysine (K). In some embodiments, the serine (S) at position 275 is substituted with lysine (K). In some embodiments, the variant amylase enzyme comprises or consists of the substitution S275K of SEQ ID NO:9.

In some embodiments, the variant amylase enzyme comprises an amino acid substitution at position 280. In some embodiments, the substitution is with any other of the 19 naturally occurring amino acids, namely serine, threonine, asparagine, glutamine, proline, arginine, histidine, glutamic acid, cysteine, glycine, phenylalanine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 280 is substituted with glutamine (Q). In some embodiments, the lysine (K) at position 280 is substituted with glutamine (Q). In some embodiments, the variant amylase enzyme comprises or consists of the substitution K280Q of SEQ ID NO:9.

In some embodiments, the variant amylase enzyme comprises an amino acid substitution at position 317. In some embodiments, the substitution is with any other of the 19 naturally occurring amino acids, namely serine, threonine, asparagine, lysine, proline, arginine, histidine, glutamic acid, cysteine, glycine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 317 is substituted with tyrosine (Y). In some embodiments, the phenylalanine (F) at position 317 is substituted with tyrosine (Y). In some embodiments, the variant amylase enzyme comprises or consists of the substitution F317Y of SEQ ID NO:9.

In some embodiments, the variant amylase enzyme comprises an amino acid substitution at position 338. In some embodiments, the substitution is with any other of the 19 naturally occurring amino acids, namely serine, threonine, asparagine, lysine, proline, arginine, histidine, glutamic acid, cysteine, leucine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 338 is substituted with aspartic acid (D). In some embodiments, the glycine (G) at position 338 is substituted with aspartic acid (D). In some embodiments, the variant amylase enzyme comprises or consists of the substitution G338D of SEQ ID NO:9.

In some embodiments, the variant amylase enzyme comprises an amino acid substitution at position 344. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, leucine, glutamine, aspartic acid, methionine, tryptophan, and tyrosine, with some embodiments not utilizing cysteine (due to possible disulfide formation) or proline (due to steric effects). In some embodiments, the amino acid at position 344 is substituted with leucine (L). In some embodiments, the valine (V) at position 344 is substituted with leucine (L). In some embodiments, the variant amylase enzyme comprises or consists of the substitution V344L of SEQ ID NO:9.

In some embodiments, the variant amylase enzyme comprises an amino acid substitution at position 351. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 351 is substituted with tyrosine (Y). In some embodiments, the leucine (L) at position 351 is substituted with tyrosine (Y). In some embodiments, the variant amylase enzyme comprises or consists of the substitution L351Y of SEQ ID NO:9.

In some embodiments, the variant amylase enzyme comprises an amino acid substitution at position 384. In some embodiments, the substitution is with any other of the 19 naturally occurring amino acids, namely serine, threonine, asparagine, proline, arginine, histidine, glutamic acid, cysteine, leucine, lysine, glycine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 384 is substituted with tryptophan (W). In some embodiments, the phenylalanine (F) at position 384 is substituted with tryptophan (W). In some embodiments, the variant amylase enzyme comprises or consists of the substitution F384W of SEQ ID NO:9.

In some embodiments, the variant amylase enzyme comprises an amino acid substitution at position 396. In some embodiments, the substitution is with any other of the 19 naturally occurring amino acids, namely serine, threonine, asparagine, proline, arginine, histidine, glutamic acid, cysteine, lysine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 396 is substituted with serine (S). In some embodiments, the leucine (L) at position 396 is substituted with serine (S). In some embodiments, the variant amylase enzyme comprises or consists of the substitution L396S of SEQ ID NO:9.

J. Specific Variants of SEQ ID NO:10

In some embodiments, the variant amylase enzymes comprise one or more (e.g., several) substitutions selected from the group consisting of Y67L, F83L, V107I, A113S, Y139F, K280Q, Q271D, S275K, Y306H, T272N, T272M, F317Y, V344L, L351Y, G338D, K383N, F384W and L396S as compared to a parent amylase enzyme of SEQ ID NO:10.

In some embodiments, the variant amylase enzyme is an isolated variant amylase enzyme.

In some embodiments, the variant amylase enzyme exhibits at least 90%, at least 95%, at least 96%, at least 97%, at least 98% or at least 99%, but less than 100%, sequence identity to the amino acid sequence of the parent amylase of SEQ ID NO:10, and the variant amylase enzyme is not any one of the homologs to Pp. Amy and Pf. Amy as shown in FIGS. 9 and 10.

In some embodiments, the variant amylase enzyme comprises at least one amino acid substitution at position(s) selected from the group consisting of Y67L, F83L, V107I, A113S, Y139F, K280Q, Q271D, S275K, Y306H, T272N, T272M, F317Y, V344L, L351Y, G338D, K383N, F384W and L396S as compared to a parent amylase enzyme. In some cases, the variant enzyme can comprise 1, 2, 3, 4, 5, 6, 7, 8, 9, 10, 11, 12, 13, 14, 15, 16, or 17 amino acid substitutions at these positions.

In some embodiments, the variant amylase enzyme comprises at least one amino acid substitution at position(s) selected from the group consisting of Y67L, F83L, V107I/Q271D/F317Y/K383N, S275K/K383N, Y139F/K383N, V107I/Y306H/K383N, V107I/Y139F/Q271D/K383N, V107I/Y306H, V107I, Y306H/K383N, L351Y/K383N, Y306H, V107I/Y139F, S275K, Y139F, Y139F/Y306H, Y139F/S275K, F317Y, V107I/K383N, K383N, A113S/V344L/F384W, K280Q/V344L/L396S, T272N/V344L, A113S, G338D/F384W, A113S/V344L, F384W/L396S, L396S and T272M as compared to a SEQ ID NO:10.

In some embodiments, the variant amylase enzyme comprises an amino acid substitution at position 67. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, phenylalanine, tryptophan, and valine, with some embodiments not utilizing cysteine (due to possible disulfide formation) or proline (due to steric effects). In some embodiments, the amino acid at position 67 is substituted with leucine (L). In some embodiments, the tyrosine (Y) at position 67 is substituted with leucine (L). In some embodiments, the variant amylase enzyme comprises or consists of the substitution Y67L of SEQ ID NO:10.

In some embodiments, the variant amylase enzyme comprises an amino acid substitution at position 83. In some embodiments, the substitution is with any other of the 19 naturally occurring amino acids, namely serine, threonine, asparagine, glutamine, proline, lysine, arginine, histidine, glutamic acid, cysteine, glycine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 83 is substituted with leucine (L). In some embodiments, the phenylalanine (F) at position 83 is substituted with leucine (L). In some embodiments, the variant amylase enzyme comprises or consists of the substitution F83L of SEQ ID NO:10.

In some embodiments, the variant amylase enzyme comprises an amino acid substitution at position 107. In some embodiments, the substitution is with any other of the 19 naturally occurring amino acids, namely serine, threonine, asparagine, glutamine, proline, lysine, arginine, histidine, glutamic acid, cysteine, glycine, phenylalanine, alanine, isoleucine, leucine, aspartic acid, methionine, tryptophan, and tyrosine, with some embodiments not utilizing cysteine (due to possible disulfide formation) or proline (due to steric effects). In some embodiments, the amino acid at position 107 is substituted with isoleucine (I). In some embodiments, the valine (V) at position 107 is substituted with isoleucine (I). In some embodiments, the variant amylase enzyme comprises or consists of the substitution V107I of SEQ ID NO:10.

In some embodiments, the variant amylase enzyme comprises an amino acid substitution at position 113. In some embodiments, the substitution is with any other of the 19 naturally occurring amino acids, namely threonine, asparagine, glutamine, serine, proline, lysine, arginine, histidine, glutamic acid, cysteine, glycine, phenylalanine, alanine, isoleucine, leucine, aspartic acid, methionine, tryptophan, valine and tyrosine, with some embodiments not utilizing cysteine (due to possible disulfide formation) or proline (due to steric effects). In some embodiments, the amino acid at position 113 is substituted with serine (S). In some embodiments, the alanine (A) at position 113 is substituted with serine (S). In some embodiments, the variant amylase enzyme comprises or consists of the substitution A113S of SEQ ID NO:10.

In some embodiments, the variant amylase enzyme comprises an amino acid substitution at position 139. In some embodiments, the substitution is with any other of the 19 naturally occurring amino acids, namely threonine, asparagine, serine, glutamine, proline, lysine, arginine, histidine, glutamic acid, cysteine, glycine, phenylalanine, alanine, isoleucine, leucine, aspartic acid, methionine, tryptophan and valine, with some embodiments not utilizing cysteine (due to possible disulfide formation) or proline (due to steric effects). In some embodiments, the amino acid at position 139 is substituted with phenylalanine (F). In some embodiments, the tyrosine (Y) at position 139 is substituted with phenylalanine (F). In some embodiments, the variant amylase enzyme comprises or consists of the substitution Y139F of SEQ ID NO:10.

In some embodiments, the variant amylase enzyme comprises an amino acid substitution at position 271. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, aspartic acid, methionine, tryptophan, tyrosine, serine and valine, with some embodiments not utilizing cysteine (due to possible disulfide formation) or proline (due to steric effects). In some embodiments, the amino acid at position 271 is substituted with aspartic acid (D). In some embodiments, the glutamine (Q) at position 271 is substituted with aspartic acid (D). In some embodiments, the variant amylase enzyme comprises or consists of the substitution Q271D of SEQ ID NO:10.

In some embodiments, the variant amylase enzyme comprises an amino acid substitution at position 272. In some embodiments, the substitution is with any other of the 19 naturally occurring amino acids, namely serine, asparagine, glycine, glutamine, lysine, aspartic acid, arginine, histidine, cysteine, alanine, isoleucine, leucine, glutamic acid methionine, proline, phenylalanine, tryptophan, valine and tyrosine, with some embodiments not utilizing cysteine (due to possible disulfide formation) or proline (due to steric effects). In some embodiments, the amino acid at position 272 is substituted with asparagine (N) or methionine (M). In some embodiments, the threonine (T) at position 272 is substituted with asparagine (N) or methionine (M). In some embodiments, the variant amylase enzyme comprises or consists of the substitution T272N or T272M of SEQ ID NO:10.

In some embodiments, the variant amylase enzyme comprises an amino acid substitution at position 275. In some embodiments, the substitution is with any other of the 19 naturally occurring amino acids, namely threonine, asparagine, lysine, proline, arginine, histidine, glutamic acid, cysteine, glycine, phenylalanine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 275 is substituted with lysine (K). In some embodiments, the serine (S) at position 271 is substituted with lysine (K). In some embodiments, the variant amylase enzyme comprises or consists of the substitution S275K of SEQ ID NO:10.

In some embodiments, the variant amylase enzyme comprises an amino acid substitution at position 280. In some embodiments, the substitution is with any other of the 19 naturally occurring amino acids, namely serine, threonine, asparagine, glutamine, proline, arginine, histidine, glutamic acid, cysteine, glycine, phenylalanine, alanine, isoleucine, leucine, aspartic acid, methionine, tryptophan, tyrosine and valine, with some embodiments not utilizing cysteine (due to possible disulfide formation) or proline (due to steric effects). In some embodiments, the amino acid at position 280 is substituted with glutamine (Q). In some embodiments, the lysine (K) at position 280 is substituted with glutamine (Q). In some embodiments, the variant amylase enzyme comprises or consists of the substitution K280Q of SEQ ID NO:10.

In some embodiments, the variant amylase enzyme comprises an amino acid substitution at position 306. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, leucine, glutamine, aspartic acid, methionine, tryptophan, and valine, with some embodiments not utilizing cysteine (due to possible disulfide formation) or proline (due to steric effects). In some embodiments, the amino acid at position 306 is substituted with histidine (H). In some embodiments, the tyrosine (Y) at position 306 is substituted with histidine (H). In some embodiments, the variant amylase enzyme comprises or consists of the substitution Y306H of SEQ ID NO:10.

In some embodiments, the variant amylase enzyme comprises an amino acid substitution at position 317. In some embodiments, the substitution is with any other of the 19 naturally occurring amino acids, namely serine, threonine, asparagine, lysine, proline, arginine, histidine, glutamic acid, cysteine, glycine, alanine, isoleucine, leucine, glutamine, aspartic acid, methionine, tryptophan, tyrosine and valine, with some embodiments not utilizing cysteine (due to possible disulfide formation) or proline (due to steric effects). In some embodiments, the amino acid at position 317 is substituted with tyrosine (Y). In some embodiments, the phenylalanine (F) at position 317 is substituted with tyrosine (Y). In some embodiments, the variant amylase enzyme comprises or consists of the substitution F317Y of SEQ ID NO:10.

In some embodiments, the variant amylase enzyme comprises an amino acid substitution at position 338. In some embodiments, the substitution is with any other of the 19 naturally occurring amino acids, namely serine, threonine, asparagine, lysine, proline, arginine, histidine, glutamic acid, cysteine, leucine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 338 is substituted with aspartic acid (D). In some embodiments, the glycine (G) at position 338 is substituted with aspartic acid (D). In some embodiments, the variant amylase enzyme comprises or consists of the substitution G338D of SEQ ID NO:10.

In some embodiments, the variant amylase enzyme comprises an amino acid substitution at position 344. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, leucine, glutamine, aspartic acid, methionine, tryptophan, and tyrosine, with some embodiments not utilizing cysteine (due to possible disulfide formation) or proline (due to steric effects). In some embodiments, the amino acid at position 344 is substituted with leucine (L). In some embodiments, the valine (V) at position 344 is substituted with leucine (L). In some embodiments, the variant amylase enzyme comprises or consists of the substitution V344L of SEQ ID NO:10.

In some embodiments, the variant amylase enzyme comprises an amino acid substitution at position 351. In some embodiments, the substitution is with any other of the 19 naturally occurring amino acids, namely serine, threonine, asparagine, lysine, proline, arginine, histidine, glutamic acid, cysteine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 351 is substituted with tyrosine (Y). In some embodiments, the leucine (L) at position 351 is substituted with tyrosine (Y). In some embodiments, the variant amylase enzyme comprises or consists of the substitution L351Y of SEQ ID NO:10.

In some embodiments, the variant amylase enzyme comprises an amino acid substitution at position 383. In some embodiments, the substitution is with any other of the 19 naturally occurring amino acids, namely serine, threonine, asparagine, proline, arginine, histidine, glutamic acid, cysteine, leucine, phenylalanine, glycine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 383 is substituted with asparagine (N). In some embodiments, the lysine (K) at position 383 is substituted with asparagine (N). In some embodiments, the variant amylase enzyme comprises or consists of the substitution K383N of SEQ ID NO:10.

In some embodiments, the variant amylase enzyme comprises an amino acid substitution at position 384. In some embodiments, the substitution is with any other of the 19 naturally occurring amino acids, namely serine, threonine, asparagine, proline, arginine, histidine, glutamic acid, cysteine, leucine, lysine, glycine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 384 is substituted with tryptophan (W). In some embodiments, the phenylalanine (F) at position 384 is substituted with tryptophan (W). In some embodiments, the variant amylase enzyme comprises or consists of the substitution F384W of SEQ ID NO:10.

In some embodiments, the variant amylase enzyme comprises an amino acid substitution at position 396. In some embodiments, the substitution is with any other of the 19 naturally occurring amino acids, namely serine, threonine, asparagine, proline, arginine, histidine, glutamic acid, cysteine, lysine, glycine, phenylalanine, alanine, isoleucine, valine, glutamine, aspartic acid, methionine, tryptophan, and tyrosine, with some embodiments not utilizing cysteine (due to possible disulfide formation) or proline (due to steric effects). In some embodiments, the amino acid at position 396 is substituted with serine (S). In some embodiments, the leucine (L) at position 396 is substituted with serine (S). In some embodiments, the variant amylase enzyme comprises or consists of the substitution L396S of SEQ ID NO:10.

The amino acid changes that may be present in addition to the specific substitutions described herein may be of a minor nature, that is conservative amino acid substitutions or insertions that do not significantly affect the folding and/or activity of the protein; small deletions, typically of 1 to about 30 amino acids; small amino- or carboxyl-terminal extensions, such as an amino-terminal methionine residue; a small linker peptide of up to about 20 to about 25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, The Proteins, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, LeuA al, Ala/Glu, and Asp/Gly.

K. Parent Amylase

The parent amylase enzyme may be (a) a polypeptide having at least 80% sequence identity to the polypeptide of SEQ ID NO:1, SEQ ID NO:2; SEQ ID NO:3, SEQ ID NO:4, SEQ ID NO:5, SEQ ID NO:6; SEQ ID NO:7, SEQ ID NO:8; SEQ ID NO:9, SEQ ID NO:10; (b) a polypeptide encoded by a polynucleotide that hybridizes under medium-high stringency conditions with (i) the mature polypeptide coding sequence of SEQ ID NO:1, SEQ ID NO:2; SEQ ID NO:3, SEQ ID NO:4, SEQ ID NO:5, SEQ ID NO:6; SEQ ID NO:7, SEQ ID NO:8; SEQ ID NO:9, SEQ ID NO:10; or (ii) the full-length complement of (i); or (c) a polypeptide encoded by a polynucleotide having at least 70% sequence identity to the mature polypeptide coding sequence of SEQ ID NO:1, SEQ ID NO:2; SEQ ID NO:3, SEQ ID NO:4, SEQ ID NO:5, SEQ ID NO:6; SEQ ID NO:7, SEQ ID NO:8; SEQ ID NO:9, SEQ ID NO:10. For hybridization methods and conditions, see for example, Sambrook et al., 1989, Molecular Cloning, A Laboratory Manual, 2d edition, Cold Spring Harbor, N.Y.

In some embodiments, the parent amylase enzyme has a sequence identity to the polypeptide of SEQ ID NO: 1 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 11 amino acids, e.g., 1, 2, 3, 4, 5, 6, 7, 8, 9, 10, or 11 from the mature polypeptide of SEQ ID NO: 1.

In some embodiments, the parent amylase enzyme has a sequence identity to the polypeptide of SEQ ID NO: 2 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 7 amino acids, e.g., 1, 2, 3, 4, 5, 6, or 7 from the mature polypeptide of SEQ ID NO: 2.

In some embodiments, the parent amylase enzyme has a sequence identity to the polypeptide of SEQ ID NO: 3 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 20 amino acids, e.g., 1, 2, 3, 4, 5, 6, 7, 8, 9, 10, 11, 12, 13, 14, 15, 16, 17, 18, 19 or 20 from the mature polypeptide of SEQ ID NO: 3.

In some embodiments, the parent amylase enzyme has a sequence identity to the polypeptide of SEQ ID NO: 4 of at least 80%, at least 85%, at least 90%, at least 91%, at least 92%, at least 93%, at least 94%, at least 95%, at least 96%, at least 97%, at least 98%, at least 99%, or 100% and have amylase activity. In one aspect, the amino acid sequence of the parent differs by up to 18 amino acids, e.g., 1, 2, 3, 4, 5, 6, 7, 8, 9, 10, 11, 12, 13, 14, 15, 16, 17, or 18 from the mature polypeptide of SEQ ID NO: 4.

In some embodiments, the parent amylase enzyme has a sequence identity to the polypeptide of SEQ ID NO: 5 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 30 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 from the mature polypeptide of SEQ ID NO: 5.

In some embodiments, the parent amylase enzyme has a sequence identity to the polypeptide of SEQ ID NO: 6 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 30 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 from the mature polypeptide of SEQ ID NO: 6.

In some embodiments, the parent amylase enzyme has a sequence identity to the polypeptide of SEQ ID NO: 7 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 30 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 from the mature polypeptide of SEQ ID NO: 7.

In some embodiments, the parent amylase enzyme has a sequence identity to the polypeptide of SEQ ID NO: 8 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 30 amino acids, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 from the mature polypeptide of SEQ ID NO: 8.

In some embodiments, the parent amylase enzyme has a sequence identity to the polypeptide of SEQ ID NO: 9 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 18 amino acids, e.g., 1, 2, 3, 4, 5, 6, 7, 8, 9, 10, 11, 12, 13, 14, 15, 16, 17, or 18 from the mature polypeptide of SEQ ID NO: 9.

In some embodiments, the parent amylase enzyme has a sequence identity to the polypeptide of SEQ ID NO: 10 of at least 80%, at least 85%, at least 90%, at least 91%, at least 92%, at least 93%, at least 94%, at least 95%, at least 96%, at least 97%, at least 98%, at least 99%, or 100%, and have amylase activity. In one aspect, the amino acid sequence of the parent differs by up to 18 amino acids, e.g., 1, 2, 3, 4, 5, 6, 7, 8, 9, 10, 11, 12, 13, 14, 15, 16, 17, or 18 from the mature polypeptide of SEQ ID NO: 10.

In some embodiments, the parent amylase enzyme is from *Palaeococcus pacificus* (A0A075LR97, noted as Pp.Amy), e.g., the amylase of SEQ ID NO:1.

In some embodiments, the parent amylase enzyme is from *Pyrococcus furiosus* (O08452, noted as Pf.Amy). e.g., the amylase of SEQ ID NO:4.

In one embodiment, the variant amylase enzymes are more stable than the parent amylase enzyme when exposed to temperatures of about 30° C., about 35° C., about 40° C., about 45° C., about 50° C., about 55° C., about 60° C., about 65° C., about 70° C., about 75° C., about 80° C., about 85° C., about 90° C., about 95° C., and/or about 100° C. for a period of time, generally ranging from about 1, 2, 3, 4, 5, 6, 7, 8, 9 or 10 minutes or longer, depending on the ultimate conditions for the use of the variant amylase enzyme, with some embodiments utilizing thermal challenge times of 5 minutes to 10 minutes, 5 minutes to 15 minutes, 5 minutes to 60 minutes, 10 minutes to 60 minutes all finding use in the present invention.

In one embodiment, the variant amylase enzymes are more stable than the parent amylase enzyme when exposed to pH of 4.0, 4.5, 5.0, 5.5, 6.0, 6.5, 7.0, 7.5, 8.0, 8.5, 9, 9.5, 10, 10.5, 11, 11.5 and 12 for a period of time, generally ranging from about 1, 2, 3, 4, 5, 6, 7, 8, 9 or 10 minutes or longer, depending on the ultimate conditions for the use of the variant amylase enzyme, with some embodiments utilizing pH challenge times of 5 minutes to 10 minutes, 5 minutes to 15 minutes, 5 minutes to 60 minutes, 5 minutes to 120 minutes, 5 minutes to 180 minutes, 5 minutes to 240 minutes, all finding use in the present invention. In some embodiments, the pH challenge time ranges from from 60 minutes to 240 minutes. In some embodiments, the pH challenge time ranges from from 60 minutes to 180 minutes. In some embodiments, the pH challenge time ranges from from 60 minutes to 120 minutes.

Accordingly, as shown in FIGS. 3-6, a number of variant amylase enzymes of the invention exhibit increased activity, thermostability, acid tolerance, acid activity and thermoactivity.

X. NUCLEIC ACID COMPOSITIONS

The present invention also provides compositions comprising a variant amylase enzyme encoding nucleic acid of the present invention. Such variant amylase polypepide encoding nucleic acids can encode any of the variant amylase enzymes recited in the present application, including under section "SPECIFIC VARIANT AMYLASES" above. In some embodiments, the composition comprises a nucleic acid selected from the sequences as shown in the Sequence listing.

In some embodiments, the variant amylase enzyme encoding nucleic acid comprises a codon optimized version or variant of any of the nucleic acid sequences. "Codon optimized" in this context is done in relation to a particular host organism and its generally preferred amino acid codons; that is, the host production organism, e.g. an *Aspergillus* species, may yield higher translation and/or secretion using *Aspergillus* preferred codons as compared to a yeast production organism.

In some embodiments, the compositions are enriched in such a variant amylase enzyme encoding nucleic acid of the present invention. The term "enriched" indicates that the amylase activity capable of being obtained from the composition has been increased, e.g., with an enrichment factor of at least 1. In some embodiments, the compositions are formulated to provide desirable characteristics such as low color, low odor and acceptable storage stability.

A. Preparation of Variants

The variants can be prepared generally by construction genes encoding the protein sequence using well known techniques, including site-directed mutagenesis of a parental gene and synthetic gene construction.

1. Regulatory Sequences

The present invention also relates to nucleic acid constructs comprising a polynucleotide encoding a variant of the present invention operably linked to one or more control sequences that direct the expression of the coding sequence in a suitable host cell under conditions compatible with the control sequences. The control sequence may include a promoter, a polynucleotide which is recognized by a host cell for expression of the polynucleotide. The promoter contains transcriptional control sequences that mediate the expression of the variant. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a filamentous fungal host cell are promoters obtained from *Aspergillus* species genes, as is known in the art, including *A. nidulans, A. niger* and *A. oryzae*, as well as *Rhizomucor* species genes such as *R. miehei, Trichoderma* species genes including *T. reesei, Fusarium* species genes including *F. venenatum*. Yeast control sequences including promoters are also well known from *Saccharomyces cerevisiae*.

Suitable promoter sequences (as well as other control sequences) from these species include the promoters from amylases (α-amylase in particular), glucoamylases, proteases, phosphatases, endoglucanases, cellulases, etc. as are known in the art. In addition, as for codon-optimization, it may be desirable to use promoters (and other control sequences) that are endogeneous to the host production strain, operably linked to the nucleic acids encoding the variant amylase.

The control sequence may also be a transcription terminator, which is recognized by a host cell to terminate transcription. The terminator sequence is operably linked to the 3'-terminus of the polynucleotide encoding the variant. Any terminator that is functional in the host cell can be used.

In some embodiments, terminators (and other control sequences such as promoters) for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

In some embodiments, terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase.

The control sequence can also be an mRNA stabilizer region downstream of a promoter and upstream of the coding sequence of a gene which increases expression of the gene.

Examples of suitable mRNA stabilizer regions are obtained from a *Bacillus thuringiensis* crylllA gene (WO 94/25612) and a *Bacillus sub tilis* SP82 gene (Hue et al., 1995, *Journal of Bacteriology* 177: 3465-3471).

The control sequence can also be a leader, a nontranslated region of an mRNA that is important for translation by the host cell. The leader sequence is operably linked to the 5'-terminus of the polynucleotide encoding the variant. Any leader that is functional in the host cell may be used.

In some embodiments, leaders for filamentous fungal host cells are obtained from the genes for *Aspergillus oryzae* TAKA amylase and *Aspergillus nidulans* triose phosphate isomerase.

In some embodiments, suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence can also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

In some embodiments, polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

The control sequence may also be a signal peptide coding region that encodes a signal peptide linked to the N-terminus of a variant and directs the variant amylase being expressed into the cell's secretory pathway. In many instances, the signal sequence is the endogenous G1P signal sequence.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

Where both signal peptide and propeptide sequences are present, the propeptide sequence is positioned next to the N-terminus of the variant and the signal peptide sequence is positioned next to the N-terminus of the propeptide sequence.

It may also be desirable to add regulatory sequences that regulate expression of the variant relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the Gpd (Glyceraldehyde-3-phosphate dehydrogenase) from Ascomycota such as *Aspergillus*, *Aspergillus niger* glucoamylase promoter, *Aspergillus oryzae* TAKA alpha-amylase promoter, and *Aspergillus oryzae* glucoamylase promoter can be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the variant would be operably linked with the regulatory sequence.

2. Expression Vectors

The present invention also relates to recombinant expression vectors comprising a polynucleotide encoding a variant of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the variant at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector can be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used. Vectors contemplated for use with the methods of the invention include both integrating and non-integrating vectors.

In some embodiments, the vector contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

In some embodiments, the vector contains an element(s) that permits integration of the vector into the host cell's genome or autonomous replication of the vector in the cell independent of the genome.

For integration into the host cell genome, the vector can rely on the polynucleotide's sequence encoding the variant or any other element of the vector for integration into the genome by homologous or non-homologous recombination. Alternatively, the vector can contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector can further comprise an origin of replication enabling the vector to replicate autonomously in the host cell in question. The origin of replication can be any plasmid replicator mediating autonomous replication that functions in a cell. The term "origin of replication" or "plasmid replicator" means a polynucleotide that enables a plasmid or vector to replicate in vivo.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention can be inserted into a host cell to increase production of a variant, including the use of multiple genes encoding the variant amylase in a vector, multiple vectors transformed into a cell, or multiple integrations of a vector into the genome. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

3. Particular Constructs

For expression in yeast, one embodiment utilizes *Saccharomyces cerevisiae* INSCV1 strain (ThermoFisher Scientific, USA: Catalogue # V8251-20) and pYES2/CT vector (ThermoFisher Scientific, USA: Catalogue # V8251-20). Both are commercially available and are also discussed in Example 1 below.

a. Codon Optimization

Codon optimization can be employed with any of the variant amylase enzymes of the present invention, in order to optimize expression in the host cell employed. Such methods are well known in the art and described in, for example, WO 2007/142954. In heterologous expression systems, optimization steps can improve the ability of the host to produce the desired variant amylase enzymes. Protein expression is governed by a host of factors including those that affect transcription, mRNA processing, and stability and initiation of translation. The polynucleotide optimization steps can include steps to improve the ability of the host to produce the foreign protein as well as steps to assist the researcher in efficiently designing expression constructs. Optimization strategies can include, for example, the modification of translation initiation regions, alteration of mRNA structural elements, and the use of different codon biases.

In some embodiments, reduced heterologous protein expression occurs through interfering secondary structures. Secondary structures can sequester the RBS sequence or initiation codon and have been correlated to a reduction in protein expression. Stemloop structures can also be involved in transcriptional pausing and attenuation. An optimized polynucleotide sequence can contain minimal secondary structures in the RBS and gene coding regions of the nucleotide sequence to allow for improved transcription and translation.

In some embodiments, restriction sites can effect heterologous protein expression. By modifying restriction sites that could interfere with subsequent sub-cloning of transcription units into host expression vectors a polynucleotide sequence can be optimized.

In some embodiments, the optimized nucleic acid sequence can express the variant amylase enzyme of the invention, at a level which is at least 110%, 150%, 200%, 500%, 1,000%, 5,000% or even 10,000% of that expressed by nucleic acid sequence that has not been optimized.

4. Host Cells and Production Strains

As will be appreciated by those in the art, there are a wide variety of production host organisms for the recombinant production of the variant amylase enzymes of the invention, including, but not limited to bacterial cells and fungal cells including yeast.

The present invention also relates to recombinant host cells, comprising a polynucleotide encoding a variant amylase of the present invention operably linked to one or more control sequences that direct the production of a variant of the present invention. A construct or vector comprising a polynucleotide is introduced into a host cell so that the construct or vector is maintained as a chromosomal integrant or as a self-replicating extrachromosomal vector as described earlier. The choice of a host cell will to a large extent depend upon the gene encoding the variant and the ability of the host production organism to yield high protein titers of expressed and/or secreted proteins. In some embodiments, the host cell exhibits transitory expression of the variant amylase. In some embodiments, the host cell is a stably transfected host or a host cell that stably (i.e., permanently) expresses the variant amylase. In some embodiments, the host cell is a production host cell. The transformation and/or transfection of the host cells with the expression vectors comprising the coding region for the variant amylase of the invention is done as is well known in the art (See Sambrook, id.).

The host cell can be any cell useful in the recombinant production of a variant, e.g., a prokaryote or a eukaryote. Such host cells include but are not limited to bacterial, fungal, and yeast cells. The host cell can also be a eukaryote, such as a mammalian, insect, plant, or fungal cell.

The host cell can be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, Ainsworth and Bisby's Dictionary of The Fungi, 8th edition, 1995, CAB International, University Press, Cambridge, UK). In many cases, host cells include *Aspergillus* species including *A. nidulans*, *A. niger* and *A. oryzae*, as well as *Rhizomucor* species such as *R. miehei*, *Trichoderma* species including *T. reesei* and *Fusarium* species genes including *F. venenatum*. The filamentous fungal host cell may be an *Acremonium*, *Aspergillus*, *Aureobasidium*, *Bjerkandera*, *Ceriporiopsis*, *Chrysosporium*, *Coprinus*, *Coriolus*, *Cryptococcus*, *Filibasidium*, *Fusarium*, *Humicola*, *Magnaporthe*, *Mucor*, *Myceliophthora*, *Neocallimastix*, *Neurospora*, *Paecilomyces*, *Penicillium*, *Phanerochaete*, *Phlebia*, *Piromyces*, *Pleurotus*, *Schizophyllum*, *Talaromyces*, *Thermoascus*, *Thielavia*, *Tolypocladium*, *Trametes*, or *Trichoderma* cell. For example, the filamentous fungal host cell may be an *Aspergillus awamori*, *Aspergillus foetidus*, *Aspergillus fumigatus*, *Aspergillus japonicus*, *Aspergillus nidulans*, *Aspergillus niger*, *Aspergillus oryzae*, *Bjerkandera adusta*, *Ceriporiopsis aneirina*, *Ceriporiopsis caregiea*, *Ceriporiopsis gilvescens*, *Ceriporiopsis pannocinta*, *Ceriporiopsis rivulosa*, *Ceriporiopsis subrufa*, *Ceriporiopsis subvermispora*, *Chrysosporium inops*, *Chrysosporium keratinophilum*, *Chrysosporium lucknowense*, *Chrysosporium merdarium*, *Chrysosporium pannicola*, *Chrysosporium queenslandicum*, *Chrysosporium tropicum*, *Chrysosporium zonaturn*, *Coprinus cinereus*, *Coriolus hirsutus*, *Fusarium*

*bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulaturn, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei,* or *Trichoderma viride* cell.

In some embodiments, the fungal host cell can be a yeast cell. "Yeast" as used herein includes ascosporogenous yeast (Endomycetales), basidiosporogenous yeast, and yeast belonging to the Fungi Imperfecti (Blastomycetes). The yeast host cell may be a *Candida, Hansenula, Kluyveromyces, Pichia, Saccharomyces, Schizosaccharomyces,* or *Yarrowia* cell such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis,* or *Yarrowia lipolytica* cell.

XI. COMPOSITIONS OF THE INVENTION

The present invention also provides compositions comprising a variant amylase enzyme of the present invention. In some embodiments, the composition comprises a carrier and/or an excipient. In some embodiments, the compositions are enriched in such a variant amylase enzyme of the present invention. The term "enriched" indicates that the amylase activity of the composition has been increased, e.g., with an enrichment factor of at least 1. In some embodiments, the compositions are formulated to provide desirable characteristics in starch processing, such as improved activity, acid activity, acid tolerance, substrate specificity, thermoactivity, thermostability and pH stability etc.

In some embodiments, the composition comprises a variant amylase enzyme of the present invention as the major enzymatic component, e.g., a mono-component composition.

In some embodiments, the composition may comprise one or more additional enzymes, depending on the end use, including, but not limited to, glucoamylases, alpha-amylases, pullulanases, glucose isomerase, bacterial alpha-amylases, bacterial hybrid alpha-amylases, fungal alpha-amylases, fungal hybrid alpha-amylases, carbohydrate-source generating enzymes (Saccharifying Enzymes), beta-amylases, maltogenic amylases, and proteases, aminopeptidase, isoamylase, carbohydrase, carboxypeptidase, catalase, cellulase, chitinase, cutinase, cyclodextrin glycosyltransferase, deoxyribonuclease, esterase, alpha-galactosidase, beta-galactosidase, alpha-glucosidase, beta-glucosidase, haloperoxidase, invertase, laccase, lipase, mannosidase, oxidase, pectinolytic enzyme, peptidoglutaminase, peroxidase, polyphenoloxidase, proteolytic enzyme, ribonuclease, transglutaminase, and/or xylanase.

In some embodiments, the composition comprises a variant amylase according to the invention and an alpha-amylase. In some embodiments, the composition comprises a variant amylase according to the invention and a glucoamylase. In some embodiments, the composition comprises a variant amylase according to the invention and a pullulanase. In some embodiments, the composition comprises a variant amylase according to the invention and a glucose isomerase. In another embodiment the composition comprises a variant amylase, an alpha-amylase, a glucoamylase, a pullulanase, and a glucose isomerase according to the invention.

In some embodiments, the composition comprises the variant amylase enzyme of the invention further comprises acid, neutral and/or alkaline proteases. In another embodiment the composition comprises the variant amylase according to the invention and one or more enzymes including an alpha-amylase, a glucoamylase, a pullulanase, a glucose isomerase, debranching glucoamylase, trehalase, acid protease, alkaline protease, peptidase, lipase, catalase, cellulase, hemicellulase, and/or others.

A. Formulations of Variant Amylases

As will be appreciated by those in the art, the formulation of the variant amylase of the invention depends on its end use and the associated conditions. Suitable formulations for the variant amylase of the invention include liquid formulations, dried formulations (including spray dried formulations), powdered formulations, granular formulations, microgranulate formulations and pelleted formulations. The variant amylases can be stabilized in accordance with methods known in the art.

In some embodiments, the enzyme composition (i.e., polypeptide compositions) of the present invention can be in any form suitable for use, such as, for example, a crude fermentation broth with or without cells removed, a cell lysate with or without cellular debris, a semi-purified or purified enzyme composition, or a host cell, as a source of the enzymes.

In some embodiments, the enzyme composition can be a dry powder or granulate, a non-dusting granulate, a liquid, a stabilized liquid, or a stabilized protected enzyme. Liquid enzyme compositions may, for instance, be stabilized by adding stabilizers such as a sugar, a sugar alcohol or another polyol, and/or lactic acid or another organic acid according to established processes.

In some embodiments, the dosage of the polypeptide composition of the invention and other conditions under which the composition is used may be determined on the basis of methods known in the art.

XII. METHODS OF PRODUCTION

The present invention also relates to methods of producing a variant amylase enzyme, comprising: (a) cultivating a host cell of the present invention under conditions suitable for expression of the variant amylase polypeptide; and (b) optionally recovering the variant amylase polypeptide.

The host cells are cultivated in a nutrient medium suitable for production of the variant amylase polypeptide using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the variant to be expressed and/or isolated. The cultivation takes place in a suitable nutrient medium comprising carbon and nitrogen sources and inorganic salts, using procedures known in the art. Suitable media are available from commercial suppliers or can be prepared according to published compositions (e.g., in catalogues of the American Type Culture Collection). If the variant amylase polypeptide is secreted into the nutrient medium, the variant amylase polypeptide can be recovered directly from the medium. If the variant is not secreted, it can be recovered from cell lysates.

The variant amylase polypeptide can be detected using methods known in the art that are specific for the variants. These detection methods include, but are not limited to, use of specific antibodies, formation of an enzyme product, or disappearance of an enzyme substrate. For example, an enzyme assay may be used to determine the activity of the variant amylase polypeptide.

The variant amylase polypeptide can be recovered using methods known in the art. For example, the variant amylase polypeptide can be recovered from the nutrient medium by conventional procedures including, but not limited to, collection, centrifugation, filtration, extraction, spray-drying, evaporation, or precipitation.

The variant can be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., Protein Purification, Janson and Ryden, editors, VCH Publishers, New York, 1989) to obtain substantially pure variants.

In an alternative aspect, the variant is not recovered, but rather a host cell of the present invention expressing the variant is used as a source of the variant.

XIII. METHODS OF USING VARIANT AMYLASES

The variant amylases of the present invention possess important properties allowing for a variety of industrial applications, such as starch liquefaction, production of fructose and glucose, detergent, food, textile, paper and biofuel or drinking alcohol industries etc.

A. Industrial Applications

In general, the major commercial application of amylase is to catalyze starch liquefaction resulting in formation of short chain dextrins, which is further hydrolyzed to produce fructose and glucose that can be used in food and fermentation processes. In general, this is a two step process, with the first step utilizing a dry solid starch slurry (30-35%, with optionally milling) that is gelatinized with a thermal treatment at 60 to 90° C. with liquifation at 95-105° C. (generally pH 6.5) with an α-amylase. The α-amylase is an endoacting enzyme, resulting in short-chain dextrins. It is this step that results in the need for a thermostable amylase. These dextrins are then saccharified by glucoamylase to release glucose, a step that is usually done at 60° C. for 2-4 days.

The variant amylases may be used for starch processes, in particular starch conversion, especially liquefaction of starch (see, e.g., U.S. Pat. No. 3,912,590, EP 252730 and EP 063909, EP 2290060, WO 99/19467, and WO 96/28567, which are all hereby incorporated by reference). Also contemplated are compositions for starch conversion purposes, which may in addition to the amylase of the invention further comprise a glucoamylase, a pullulanase and/or a protease.

In some embodiments, the present invention provides a biofuel or drinking alcohol made by the use of a variant amylase enzyme that produces a viscous starch suspension followed by a saccharification process to produce glucose, which is then subjected to a fermentation step to result in ethanol production (usually using a yeast).

Further, the amylases of the invention are particularly useful in the production of sweeteners and ethanol (see, e.g., U.S. Pat. No. 5,231,017, which is hereby incorporated by reference), such as fuel, drinking and industrial ethanol, from starch or whole grains.

In some embodiments, the present invention relates to a use of the amylase according to the invention for production of syrup and/or a fermentation product from a starch containing material. The starch material may in one embodiment be gelatinized. In another embodiment the starch material is ungelatinized.

1. Starch Processing and Production of Fructose and Glucose

As discussed herein, the novel amylase enzymes of the invention find particular use in starch processing. Native starch consists of microscopic granules, which are insoluble in water at room temperature. When aqueous starch slurry is heated, the granules swell and eventually burst, dispersing the starch molecules into the solution. At temperatures up to about 50° C. to 75° C. the swelling may be reversible. However, with higher temperatures an irreversible swelling called "gelatinization" begins. During this "gelatinization" process there is a dramatic increase in viscosity. Granular starch to be processed may be a highly refined starch quality, preferably at least 90%, at least 95%, at least 97% or at least 99.5% pure or it may be a more crude starch-containing materials comprising (e.g., milled) whole grains including nonstarch fractions such as germ residues and fibers. The raw material, such as whole grains, may be reduced in particle size, e.g., by milling, in order to open up the structure and allowing for further processing. In dry milling whole kernels are milled and used. Wet milling gives a good separation of germ and meal (starch granules and protein) and is often applied at locations where the starch hydrolyzate is used in the production of, e.g., syrups or other feed supplements. Both dry and wet milling is well known in the art of starch processing and may be used in a process of the invention. Methods for reducing the particle size of the starch containing material are well known to those skilled in the art.

Starch is used in the production of fructose and glucose syrups. As discussed above, this process involves steps of gelatinization, liquefaction, and saccharification. Gelatinization involves the dissolving of starch granules in water to form a viscous starch suspension. The amylase and amylopectin are dispersed into the water on dissolution. Liquefaction of starch is partial hydrolysis into short chain dextrins by α-Amylase resulting in reduction of the viscosity of the starch suspension. Saccharification is the production of glucose and fructose syrup by further hydrolysis. This is carried out by glucoamylase which acts as an exo-amylase by cleaving the α-1,4 glycosidic linkages from the non reducing terminal. The action of pullulanase along with glucoamylase yields high glucose syrup. This high glucose syrup can then be converted into high fructose syrup by isomerization catalysed by glucose isomerase. The fructose syrup obtained is used as a sweetener, especially in the beverage industry (Ajita Sundarram, Thirupathihalli Pandurangappa Krishna Murthy, 2014, Journal of Applied & Environmental Microbiology, 2(4): 166-175).

As the solids level is 30-40% in a typical industrial starch process, the starch has to be thinned or "liquefied" so that it can be suitably processed. Liquefaction can be carried out in the presence of an alpha-amylase, and in some embodiments, the alpha-amylase is a bacterial alpha-amylase and/or acid fungal alpha-amylase.

In one embodiment, the invention provides methods of hydrolyzing starch and/or reducing viscosity of a starch suspension comprising contacting a variant amylase with said starch. In some embodiments, a glucoamylase is also present during liquefaction. In some embodiments, viscosity reducing enzymes such as a xylanase and/or beta-glucanase is also present during liquefaction. In some embodiments, acid protease is also present. In some embodiments, acid protease is also present to reduce corn steeping time.

In some embodiments, the process of the invention further comprises, prior to the conversion of a starch-containing material to sugars/dextrins the steps of: (i) reducing the particle size of the starch-containing material; and (ii) forming a slurry comprising the starch containing material and water.

2. Food/Bakery Industry

In some embodiments, variant amylase of the present invention is added to the dough in bread baking process, which causes the starch to hydrolyze into small dextrins which can further be fermented by yeast. This increases the rate of fermentation. Also the starch hydrolysis decreases the viscosity of the dough, thus improving its texture and increasing loaf volume by rising of dough.

Once the baking is done, there may be changes during storage of baked products. All undesirable changes like increase of crumb firmness, loss of crispness of the crust, decrease in moisture content of the crumb and loss of bread flavor together are called staling (Ajita Sundarram, Thirupathihalli Pandurangappa Krishna Murthy, 2014, Journal of Applied & Environmental Microbiology, 2(4): 166-17.). In some embodiments, the present invention provides methods of improving shelf life and retaining softness of baked goods by using variant amylase enzymes as anti staling agents. Though it has an anti staling effect, a slight overdose may result in gummyness of the bread. This is caused due to production of branched dextrins Ajita Sundarram, Thirupathihalli Pandurangappa Krishna Murthy, 2014, Journal of Applied & Environmental Microbiology, 2(4): 166-175). In some embodiments, pullulanase is used in combination with the variant amylase resulting in specific hydrolysis of compounds responsible for the gummy nature of amylase treated bread.

3. Beer Making

The variant amylase enzymes can also be used in a beer-making process and similar fermentations. Optionally, following fermentation, an alcohol (e.g., ethanol) can be extracted by, for example, distillation and optionally followed by one or more process steps.

4. Biofuel Alcohol Production

Among biofuels, ethanol is most widely used. As starch is an economical starting material, it is used for the production of ethanol as a biofuel. This is done in a series of steps as described above. Firstly, the starch is subjected to liquefaction to form a viscous starch suspension. This is followed by the saccharification process where the starch is hydrolyzed by α-Amylase to yield fermentable sugars. These sugars are then fermented by yeast to produce alcohol. As an improvisation of this process, protoplast fusion between the amylolytic yeast Saccharomyces fibuligera and S. cerevisiae was performed to obtain a new yeast strain that can directly produce the biofuel from starch, eliminating the need for a saccharification step (Ajita Sundarram, Thirupathihalli Pandurangappa Krishna Murthy, 2014, Journal of Applied & Environmental Microbiology, 2(4): 166-175).

In some embodiments, the present invention provides methods of producing biofuel alcohol from starch comprising use of variant amylase enzymes. In some embodiments, the variant amylase enzymes can be combined with enzymes including but not limited to glucoamylases, alpha-amylases, bacterial alpha-amylases, bacterial hybrid alpha-amylases, fungal alpha-amylases, fungal hybrid alpha-amylases, carbohydrate-source generating enzymes (Saccharifying Enzymes), beta-amylases, maltogenic amylases, glucoamylases, pullulanases, and proteases.

5. Detergent Industry

The use of enzymes in detergents has increased with the changing methods of dishwashing and laundry. Earlier the chemicals used in detergents caused harm when ingested and the conditions of dishwashing were very harsh. Hence enzymes showed the industry an alternative path. The enzymes are environmentally safe and work at mild conditions (Ajita Sundarram, Thirupathihalli Pandurangappa Krishna Murthy, 2014, Journal of Applied & Environmental Microbiology, 2(4): 166-175).

In some embodiments, the invention provides a detergent comprising variant amylase enzyme(s). In some embodiments, the variant amylases of the invention are formulated and added to a detergent or can be made as a component of a detergent. In some embodiments, the detergent is a laundry detergent. In some embodiments, the detergent is a dishwashing detergent.

In some embodiments, the invention provides methods of digesting starch-containing food particles into smaller water soluble oligosaccharides by use of the variant amylase enzymes. Starch can attract soil particles on to the clothes. Hence removal of starch is also important to maintain the whiteness of clothes.

6. Desizing of Textiles

Modern production processes in the textile industry can cause breaking of the warp thread. To strengthen the thread, sizing agents are used which strengthen the thread by forming a layer on it and can be removed after the fabric is woven. Starch is a preferred sizing agent as it is easily available, cheaper and can be easily removed from the fabric. The layer of starch is subjected to hydrolysis in the desizing process where α-Amylase is employed to cleave starch particles randomly into water soluble components that can be removed by washing. The enzyme acts specifically on the starch molecules alone, leaving the fibers unaffected (Ajita Sundarram, Thirupathihalli Pandurangappa Krishna Murthy, 2014, Journal of Applied & Environmental Microbiology, 2(4): 166-175).

In some embodiments, the present invention provides a desizing agent comprising variant amylase enzyme(s) to cleave starch particles particles into water soluble components in textile industry.

In some embodiments, the present invention provides methods of cleaving starch particles particles into water soluble components in textile industry by the use of variant amylase enzyme(s).

7. Paper Industry

Like textiles, paper is also treated with sizing agents to protect it from mechanical strain during processing. The sizing also contributes to better quality of the paper in terms of strength, smoothness, writing and erasebility. Starch is commonly used as the sizing agent. The role of α-Amylase in the paper industry is the partial hydrolysis of starch to make it less viscous in a batch or a continuous process. This is owing to the highly viscous nature of natural starch making it unsuitable for coating on paper (Ajita Sundarram, Thirupathihalli Pandurangappa Krishna Murthy, 2014, Journal of Applied & Environmental Microbiology, 2(4): 166-175.).

In some embodiments, the present invention provides a desizing agent comprising variant amylase enzyme(s) to partially hydrolyze starch to reduce its viscosity for application in paper industry.

In some embodiments, the present invention provides methods of partially hydrolyzing starch to reduce its viscosity for application in paper industry by the use of variant amylase enzyme(s).

B. Combinations

The variant enzymes of the invention can be combined with other enzymes, including glucoamylases, beta amylases, phytases, etc.

In some embodiments, a beta-amlyase can be included in the compositions of the invention. A beta-amylase (E.3.2.1.2) is the name traditionally given to exo-acting maltogenic amylases, which catalyze the hydrolysis of 1,4-alpha-glucosidic linkages in amylose, amylopectin and related glucose polymers.

A commercially available beta-amylase from barley is NOVOZYM™ WBA from Novozymes A/S, Denmark and SPEZYME™ BBA 1500 from DuPont Industrial Biosciences, USA.

In some embodiments, a maltogenic amlyase can be included in the compositions of the invention and/or used in the pocesses of the invention. The amylase can be a maltogenic alpha-amylase (glucan 1,4-alpha-maltohydrolase, EC 3.2.1.133), which catalyzes the hydrolysis of amylose and amylopectin to maltose in the alpha-configuration. A maltogenic amylase from *Bacillus stearothermophilus* strain NCIB 1 1837 is commercially available from Novozymes A/S. Maltogenic.

The maltogenic amylase can be added in an amount of 0.05-5 mg total protein/gram DS or 0.05-5 MANU/g DS.

In some embodiments, a phytase can be included in the compositions of the invention. Any phytase may be used in a process of the present invention. Phytases can also include those in PCT application number PCT/US2016/040555, filed on Jun. 30, 2016, hereby incorporated by reference in its entirety, and in particular for the sequences of the phytases depicted therein.

In some embodiments, the glucoamylase is a commercially-available phytase, such commercially-available phytases include but are not limited to NATUPHOS (BASF), RONOZYME P (Novozymes A/S), PHYZYME (Danisco A/S, Verenium) and FINASE (AB Enzymes). The method for determining microbial phytase activity and the definition of a phytase unit is disclosed in Engelen et al., 1994, Journal of AOAC International 77: 760-764. In some embodiments, the phytase can be a wild-type phytase, an active variant or active fragment thereof.

In some embodiments, a pullulanase can be included in the compositions of the invention and/or used in the pocesses of the invention. Pullulanases (E.C. 3.2.1.41, pullulan 6-glucano-hydrolase), are debranching enzymes characterized by their ability to hydrolyze the alpha-1,6-glycosidic bonds in, for example, amylopectin and pullulan.

In some embodiments, the pullulanase is a commercially-available pullulanase, such commercially-available pullulanases include but are not limited to PROMOZYME D, PROMOZYME™ D2 (Novozymes A/S, Denmark), OPTIMAX L-1000, OPTIMAX L-300 (DuPont Industrial Biosciences), and AMANO 8 (Amano, Japan).

A protease can be added during saccharification, fermentation, simultaneous saccharification and fermentation. The protease may be any protease. In some embodiments, the protease is an acid protease of microbial origin, for example of fungal or bacterial origin. In some embodiments, the protease is an acid fungal protease, but also other proteases can be used.

Suitable proteases include but are not limited to microbial proteases, such as fungal and bacterial proteases.

In some embodiments, the proteases are acidic proteases, i.e., proteases characterized by the ability to hydrolyze proteins under acidic conditions below pH 7.

The protease can be a neutral or alkaline protease, such as a protease derived from a strain of *Bacillus*. In some embodiments, the particular protease is derived from *Bacillus amyloliquefaciens* and has the sequence obtainable at the Swissprot Database, Accession no. P06832.

In some embodiments, the protease is a protease preparation derived from a strain of *Aspergillus*, such as *Aspergillus oryzae*. In another embodiment the protease is derived from a strain of *Rhizomucor*, such as *Rhizomucor miehei*. In some embodiments the protease is a protease preparation, such as a mixture of a proteolytic preparation derived from a strain of *Aspergillus*, such as *Aspergillus oryzae*, and a protease derived from a strain of *Rhizomucor*, such as *Rhizomucor miehei*.

In some embodiments, the protease is a commercially-available protease, such commercially-available proteases include but are not limited to ALCALASE®, ESPERASE™, FLAVOURZYME™, NEUTRASE®, NOVOZYM™ FM 2.0L, and iZyme BA (available from Novozymes A/S, Denmark) and GC106™ and SPEZYME™ FAN from DuPont Industrial Biosciences, USA, and RENNI LASE® from DSM.

XIV. EXAMPLES

Example 1: Gene Synthesis and Cloning

Two amylases have been identified: one is from *Palaeococcus pacificus* (A0A075LR97, noted as Pp.Amy), the other is from *Pyrococcus furiosus* (008452, noted as Pf.Amy). The starting genes of them were synthesized by GenScript. The synthesized genes were cloned into the pESC-URA vector (Agilent Technologies, Santa Clara, Calif., Catalogue #217454).

Example 2: Mutant Collection Design and Construction

Three generations of improvement were completed for Pp.Amy and one generation of improvement was completed for Pf.Amy. The starting amylase gene was used as the parent (G1P). To improve the activity, thermostability and acid tolerance of Pp.Amy, 10 mutant collections were designed based on its protein sequence and homology model. To improve the activity, thermostability and acid tolerance of Pf.Amy, 4 mutant collections were designed based on its protein sequence and crystal structure. The design includes one to multiple specific mutations per variant. The mutant collections were constructed using standard site-directed mutagenesis methods and subsequently cloned into the pESC-URA vector (Agilent Technologies, Santa Clara, Calif., Catalogue #217454) with an additional leader sequence.

Example 3: Preparation of HTP Amylase-Containing Wet Cell Pellets

The *Saccharomyces cerevisiae* INSCV1 strain (ThermoFisher Scientific, USA: Catalogue # V8251-20) containing recombinant amylase-encoding genes from single colonies were inoculated into individual wells of 96 well plates containing 300 µl synthetic minimal defined medium (SC) with 2% glucose and no uracil supplementation. The cultures were grown overnight at 30° C., 250 rpm and 85% humidity. Appropriate volume of overnight culture from each well needed to obtain an OD600 of 0.4 was added to corresponding wells of the new 96 well plates containing 350 µl of induction medium (SC selective medium containing 2% galactose). The plates were then incubated for 24 hrs. at 30° C., 250 rpm and 85% humidity. The cells were then pelleted using centrifugation at 4000 rpm for 10 min at 4° C. The supernatants were discarded, and the pellets frozen at −80° C. prior to lysis.

Example 4: Lysis of the HTP Amylase Plates

150 µL of Y-PER yeast protein extraction reagent (ThermoFisher Scientific, USA: Catalogue #78990) was added to the cell paste in each well as described above. The cells were lysed at room temperature for 1.5 hrs. lysis method was used with shaking on a bench top shaker. The plate was then centrifuged for 10 min at 4000 rpm and 4° C. The clear supernatants were used to perform biochemical assays to determine activity.

Example 5: Evaluate the Temperature Profile of Pp.Amy and Pf.Amy (G1P) at pH6.0 and pH4.6

10 µl of the enzymes from the lysate plates was added to 96 well Biorad PCR plates containing 30 µL of 2.5% heated corn starch solution with 10 µL of 128 mM Phosphate buffer (pH 6) containing 50 mM $CaCl_2$ or 500 mM sodium acetate (pH 4.6) containing 50 mM $CaCl_2$. The plates were incubated at temperature ranging from 30-90° C. for 3 hrs. After 3 hrs, the plates were centrifuged at 4,000 rpm for 1 minute and 100 µL of DNS reagent was added to the plate. After that the plates were incubated at 100° C. for 5 minutes and chilled at 4° C. for 2 minutes. Centrifuge plates at 4,000 rpm for 5 minutes and transfer 100 µL of above reaction to NUNC plates. The plates were read at 540 nm to monitor reducing sugar released due to breakdown of starch.

Figure 1B:
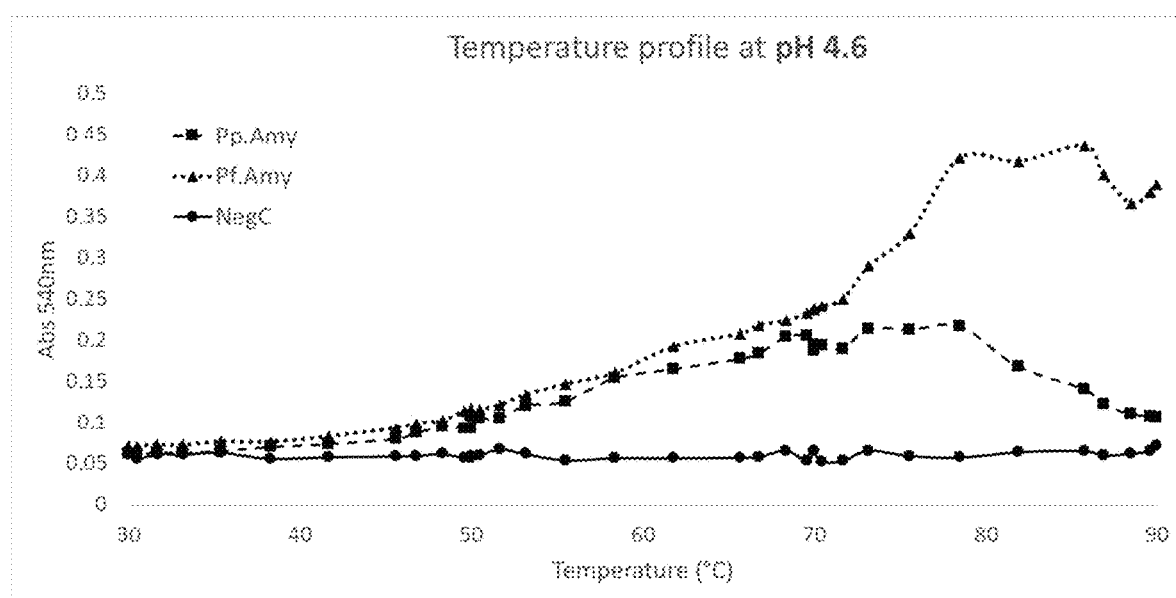

The results are shown in FIG. 1. The results suggest under the tested conditions, Pp.Amy was not stable at pH4.6 and 80° C.-90° C., while Pf.Amy exhibited optimal activity at pH4.6 and 80° C.-90° C. Since pH4.6 and 100° C. are the liquefaction process relevant conditions, our goal is to further improve the activity of Pp.Amy and Pf.Amy at pH4.6, 100° C. by improving its activity, thermostability, and/or acid tolerance.

Example 6: G1-G3 Screening of Pp.Amy Mutants for Improved Activity, Thermostability or Acid Tolerance a. Activity Improvement Assay:

10 µl of the enzymes from the lysate plates was added to 96 well Biorad PCR plates containing 30 µL of 2.5% heated corn starch solution with 10 µL of 128 mM Phosphate buffer (pH 6) containing 50 mM $CaCl_2$ in G1. The plates were incubated at 78° C. for 3 hrs. After 3 hrs, the plates were centrifuged at 4,000 rpm for 1 minute and 100 µL of DNS reagent was added to the plate. After that the plates were incubated at 100° C. for 5 minutes and chilled at 4° C. for 2 minutes. Centrifuge plates at 4,000 rpm for 5 minutes and transfer 100 µL of above reaction to NUNC plates. The plates were read at 540 nm to monitor reducing sugar released due to breakdown of starch.

b. Activity and Acid Activity Improvement Assay:

10 µl of the enzymes from the lysate plates was added to 96 well Biorad PCR plates containing 30 µL of 2.5% heated corn starch solution with 10 µL of 500 mM acetate buffer (pH 4.6) containing 18.75 mM $CaCl_2$ in G2 and G3. The plates were incubated at 85 and 85° C. for 3 hrs in G2 and G3 respectively. After 3 hrs, the plates were centrifuged at 4,000 rpm for 1 minute and 100 µL of DNS reagent was added to the plate. After that the plates were incubated at 100° C. for 5 minutes and chilled at 4° C. for 2 minutes. Centrifuge plates at 4,000 rpm for 5 minutes and transfer 100 µL of above reaction to NUNC plates. The plates were read at 540 nm to monitor reducing sugar released due to breakdown of starch.

c. Thermostability and Acid Tolerance Improvement Assay:

50 µl of the two-fold diluted enzyme lysate using 500 mM sodium acetate buffer (pH 4.6) was added to 96 well Biorad PCR plates. The plate was then incubated at 67, 88, and 96° C. for 10 minutes in G1, G2, G3 respectively. After the pre-incubation the plates were centrifuged at 4,000 rpm for 5 minutes. Transfer 10 µL of pre-incubated enzyme to 96 well Biorad PCR plates containing 30 µL of 2.5% heated corn starch solution with 10 µL of 128 mM Phosphate buffer (pH 6) containing 50 mM $CaCl_2$ in G1, 500 mM sodium acetate (pH 4.6) containing 18.75 mM $CaCl_2$ in G2 and G3 respectively. The plates were incubated at 78, 85, and 85° C. for 3 hrs in G1, G2, and G3 respectively. After 3 hrs, the plates were centrifuged at 4,000 rpm for 1 minute and 100 µL of DNS reagent was added to the plate. After that the plates were incubated at 100° C. for 5 minutes and chilled at 4° C. for 2 minutes. Centrifuge plates at 4,000 rpm for 5 minutes and transfer 100 µL of above reaction to NUNC plates. The plates were read at 540 nm to monitor reducing sugar released due to breakdown of starch.

d. Activity, Thermoactivity and Acid Activity Improvement Assay:

10 µl of the enzymes from the lysate plates was added to 96 well Biorad PCR plates containing 30 µL of 2.5% heated corn starch solution with 10 µL of 500 mM sodium acetate (pH 4.6) containing 50, 18.75, and 18.75 mM $CaCl_2$ in G1, G2, and G3 respectively. The plates were incubated at 85, 95, and 95° C. for 3 hrs in G1, G2, and G3 respectively. After 3 hrs, the plates were centrifuged at 4,000 rpm for 1 minute and 100 µL of DNS reagent was added to the plate. After that the plates were incubated at 100° C. for 5 minutes and chilled at 4° C. for 2 minutes. Centrifuge plates at 4,000 rpm for 5 minutes and transfer 100 µL of above reaction to NUNC plates. The plates were read at 540 nm to monitor reducing sugar released due to breakdown of starch.

The results are shown in FIGS. 3-5. The results suggest mutations that improve the activity, thermostability, and/or acid tolerance of Pp.Amy.

Example 7: G1 Screening of Pf.Amy Mutants for Improved Activity, Thermostability and Acid Tolerance a. Activity Improvement Assay:

10 µl of the enzymes from the lysate plates was added to 96 well Biorad PCR plates containing 30 µL of 2.5% heated corn starch solution with 10 μL of 128 mM Phosphate buffer (pH 6). The plates were incubated at 70° C. for 3 hrs. After 3 hrs, the plates were centrifuged at 4,000 rpm for 1 minute and 100 μL of DNS reagent was added to the plate. After that the plates were incubated at 100° C. for 5 minutes and chilled at 4° C. for 2 minutes. Centrifuge plates at 4,000 rpm for 5 minutes and transfer 100 μL of above reaction to NUNC plates. The plates were read at 540 nm to monitor reducing sugar released due to breakdown of starch.

b. Thermostability Improvement Assay:

50 μl of the enzyme lysate was added to 96 well Biorad PCR plates. The plate was then incubated at 100° C. for 35 minutes. After the pre-incubation the plates were centrifuged at 4,000 rpm for 5 minutes. Transfer 10 μL of pre-incubated enzyme to 96 well Biorad PCR plates containing 30 μL of 2.5% heated corn starch solution with 10 μL of 128 mM Phosphate buffer, pH 6. The plates were incubated at 70° C. for 4 hrs. After 4 hrs, the plates were centrifuged at 4,000 rpm for 1 minute and 100 μL of DNS reagent was added to the plate. After that the plates were incubated at 100° C. for 5 minutes and chilled at 4° C. for 2 minutes. Centrifuge plates at 4,000 rpm for 5 minutes and transfer 100 μL of above reaction to NUNC plates. The plates were read at 540 nm to monitor reducing sugar released due to breakdown of starch.

c. Thermoactivity Improvement Assay:

10 μl of the enzymes from the lysate plates was added to 96 well Biorad PCR plates containing 30 μL of 2.5% heated corn starch solution with 10 μL of 128 mM Phosphate buffer (pH 6). The plates were incubated at 100° C. for 3 hrs. After 3 hrs, the plates were centrifuged at 4,000 rpm for 1 minute and 100 μL of DNS reagent was added to the plate. After that the plates were incubated at 100° C. for 5 minutes and chilled at 4° C. for 2 minutes. Centrifuge plates at 4,000 rpm for 5 minutes and transfer 100 μL of above reaction to NUNC plates. The plates were read at 540 nm to monitor reducing sugar released due to breakdown of starch.

d. Activity, Thermoactivity, and Acid Activity Improvement Assay:

10 μl of the enzymes from the lysate plates was added to 96 well Biorad PCR plates containing 30 μL of 2.5% heated corn starch solution with 10 μL of 500 mM sodium acetate (pH 4.6). The plates were incubated at 100° C. for 3 hrs. After 3 hrs, the plates were centrifuged at 4,000 rpm for 1 minute and 100 μL of DNS reagent was added to the plate. After that the plates were incubated at 100° C. for 5 minutes and chilled at 4° C. for 2 minutes. Centrifuge plates at 4,000 rpm for 5 minutes and transfer 100 μL of above reaction to NUNC plates. The plates were read at 540 nm to monitor reducing sugar released due to breakdown of starch.

The results are shown in FIG. 6. The results suggest mutations that improve the activity, thermostability, and/or acid tolerance of Pf.Amy.

Example 8: Construction of Pf.Amy Variant G1V1

Pf.Amy variant G1V1 was amplified by PCR using pESC-alphaG136 for primer (tcatcctcgagaaaagagaggccgaagctGCTAAGTACTTGGAATTG, the lower case letters are linker sequence and the underline letter sequence is XhoI site) and pESC-alphaG136 rev primer (taccggcggccgcttattaACCAACACCACAATA, the lower case letters are linker sequence and the underline letter sequence is NotI site) with 5'XhoI and 3' NotI cloning site and pESC-alpha-FL-CL52982 as a template. Following PCR and restriction digestion, it was cloned into pPICZαA vector (EasySelect *Pichia* Expression Kit, Invitrogen by life technologies). The recombinant plasmid was linearized using Pme1 restriction enzyme and was transformed into X33 *Pichia* strain from the same expression kit mentioned earlier. The transformants were then selected on YPD+ Zeocin agar plates after 3 days of growth at 30° C.

Example 9: Preparation of Pf.Amy Variant G1V1 Produced by *Pichia pastoris* in HTP Pf.Amy G1V1-encoding gene from single colonies was inoculated into individual wells of 24 well plates containing 2000 μl of BMGY medium according to ThermoFisher Scientific recipe. The cultures were grown for 18 hrs at 30° C., 200 rpm and 85% humidity. After 18 hrs, centrifuge 24 wells plate and decant the liquid media. Into the pellet, add 2000 μl of BMMY medium according to ThermoFisher Scientific recipe. Add 200 μl of 10% methanol to each plate. The plates were incubated at 30° C., 200 rpm and 85% humidity incubator. At every 24 hrs, add 200 μl of 10% methanol to each plate. Harvest plate at 72 hrs by centrifuging plates at 4,000 rpm at 4° C. for 10 minutes. The supernatants were transferred to costar deep wells plates and stored at −20° C. prior to activity assay.

Example 10: Enzymatic Assay to Determine *Pichia pastoris* Produced Pf.Amy Variant G1V1 Activity at Different Temperatures for pH4.6 and pH6

The supernatant from Example 9 was diluted at least 32-fold using 0.1M sodium acetate buffer, pH4.6 or 0.1M citro phosphate buffer, pH6.0. Into reaction plate, transfer 10 μL of diluted enzyme with 10 μL of 0.5M sodium acetate buffer, pH4.6 or 0.5M citro phosphate buffer, pH6.0 with 0.00117M $CaCl_2$ with 30 μL of 2.5% heated starch. Seal the plates and react at desired temperatures for 30 minutes. After 30 minutes of incubation, add 100 μL of DNS reagent to reaction plates. Heat plates at 95° C. for 5 minutes cool to 4° C. for 2 minutes and centrifuge plates. Transfer 100 μL of reaction samples into NUNC plates and read absorbance at 540 nm. DNS reagent can be prepared as follows:

1. Weigh 1 g of DNS and 1.6 g of NaOH to dissolve in 70 mL of water.
2. Stir the mixture and keep away from light.
3. When dissolved, add 30 g of Rochelle salt to the beaker and mix.
4. Bring volume to 100 mL for DNS reagent.

The temperature profile of Pf.Amy G1V1 at pH4.6 and pH6 and the pH stability of Pf.Amy G1V1 were determined and are shown in FIGS. 13A, 13B, and 15.

Example 11: Thermochallenge Assay to Determine *Pichia pastoris* Produced Pf.Amy Variant G1V1 Activity at pH6

The supernatant from Example 9 was diluted at least 32-fold using 0.1M citro phosphate buffer, pH6.0. Into BioRad PCR plate, transfer 70 μL of diluted enzyme and heat challenge in PCR machine at 100° C. for 10 minutes, 30 minutes, and 60 minutes. Once heat challenge is complete, transfer 10 μL of heat challenged enzyme add 10 μL of 0.5M citro phosphate buffer, pH6.0 with 0.00117M $CaCl_2$ with 30 μL of 2.5% heated starch. Seal the plates and react at desired temperatures for 30 minutes. After 30 minutes of incubation, add 100 μL of DNS reagent to reaction plates. Heat plates at 95° C. for 5 minutes cool to 4° C. for 2 minutes and centrifuge plates. Transfer 100 μL of reaction samples into NUNC plates and read absorbance at 540 nm. DNS reagent can be prepared as follows:

1. Weigh 1 g of DNS and 1.6 g of NaOH to dissolve in 70 mL of water.
2. Stir the mixture and keep away from light.
3. When dissolved, add 30 g of Rochelle salt to the beaker and mix.
4. Bring volume to 100 mL for DNS reagent.

The thermostability of Pf.Amy G1V1 at pH6.0 was determined and is shown in FIG. 14.

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only.

SEQUENCE LISTING (236 sequences)

SEQ ID NO: 1 - protein, 432 aa, Artificial Sequence
  Synthetic Amylase (CL00026174 Pp.Amy G1P)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 2 - protein, 432 aa, Artificial Sequence
  Synthetic Amylase (CL00036023 Pp.Amy G1V1 (G2P))
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 3 - protein, 432 aa, Artificial Sequence
  Synthetic Amylase (CL00037702 Pp.Amy G2V1 (G3P))
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 4 - protein, 435 aa, Artificial Sequence
  Synthetic Amylase (CL00049011 Pf.Amy G1P)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 5 - protein, 432 aa, Artificial Sequence
  Synthetic Amylase (CL00035374 Pp.Amy G1V2)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 6 - protein, 432 aa, Artificial Sequence
  Synthetic Amylase (CL00035771 Pp.Amy G1V3)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHNKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 7 - protein, 432 aa, Artificial Sequence
  Synthetic Amylase (CL00035764 Pp.Amy G1V4)
LSPEEGGVMMQAFYWDVPEGGAWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 8 - protein, 432 aa, Artificial Sequence
  Synthetic Amylase (CL00035000 Pp.Amy G1V5)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGTYGYSVWSYAGIG

SEQ ID NO: 9 - protein, 435 aa, Artificial Sequence
  Synthetic Amylase (CL00052982 Pf.Amy G1V1)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTHEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 10 - protein, 435 aa, Artificial Sequence
  Synthetic Amylase (CL00050960 Pf.Amy G1V2)
AKYLELEEGGVIMQAFYWKVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 11 - protein, 432 aa, Artificial Sequence
  Synthetic Amylase (CL00034838)
LSPEEGGVMMQAFYWDVPAGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 12 - protein, 371 aa, Artificial Sequence
  Synthetic Amylase (CL00034918)
YDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQTGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 13 - protein, 432 aa, Artificial Sequence
  Synthetic Amylase (CL00034919)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIHGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 14 - protein, 432 aa, Artificial Sequence
  Synthetic Amylase (CL00034933)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQCGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 15 - protein, 432 aa, Artificial Sequence
  Synthetic Amylase (CL00034936)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPGNGYYGYSVWSYAGIG

SEQ ID NO: 16 - protein, 432 aa, Artificial Sequence
  Synthetic Amylase (CL00034950)
LSPEEGGVMMQAFYWDVPDGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 17 - protein, 432 aa, Artificial Sequence
  Synthetic Amylase (CL00035021)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTYLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 18 - protein, 432 aa, Artificial Sequence
  Synthetic Amylase (CL00035092)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGLYGYSVWSYAGIG

SEQ ID NO: 19 - protein, 432 aa, Artificial Sequence
  Synthetic Amylase (CL00035110)
LSPEEGGVMMQAFYWDVPEGGIWYDTIRAKIPDWAAAGITSIWLPPPSKGMSGGYSMGYDPYDYFDLGEYWQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 20 - protein, 432 aa, Artificial Sequence
  Synthetic Amylase (CL00035119)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTVLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 21 - protein, 432 aa, Artificial Sequence
  Synthetic Amylase (CL00035153)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLNGWVDKWVDSNGWVYLEAPPHDPANGYYGYSVWSYAGIG

SEQ ID NO: 22 - protein, 432 aa, Artificial Sequence
  Synthetic Amylase (CL00035195)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLTGWVDKWVDSNGWVYLEAPPHDPANGYYGYSVWSYAGIG

SEQ ID NO: 23 - protein, 432 aa, Artificial Sequence
  Synthetic Amylase (CL00035200)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTFLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 24 - protein, 432 aa, Artificial Sequence
  Synthetic Amylase (CL00035271)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSRVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 25 - protein, 432 aa, Artificial Sequence
  Synthetic Amylase (CL00035301)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTTLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 26 - protein, 432 aa, Artificial Sequence
  Synthetic Amylase (CL00035364)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLPGWVDKWVDSNGWVYLEAPPHDPANGYYGYSVWSYAGIG

SEQ ID NO: 27 - protein, 432 aa, Artificial Sequence
  Synthetic Amylase (CL00037324)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTALIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 28 - protein, 432 aa, Artificial Sequence
  Synthetic Amylase (CL00037336)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTLLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 29 - protein, 432 aa, Artificial Sequence
  Synthetic Amylase (CL00037348)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTGLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 30 - protein, 432 aa, Artificial Sequence
  Synthetic Amylase (CL00037355)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTCLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 31 - protein, 432 aa, Artificial Sequence
  Synthetic Amylase (CL00037383)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 32 - protein, 432 aa, Artificial Sequence
  Synthetic Amylase (CL00037385)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTKLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 33 - protein, 432 aa, Artificial Sequence
  Synthetic Amylase (CL00037406)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 34 - protein, 432 aa, Artificial Sequence
  Synthetic Amylase (CL00037470)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTSLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 35 - protein, 432 aa, Artificial Sequence
  Synthetic Amylase (CL00037593)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTTLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 36 - protein, 432 aa, Artificial Sequence
  Synthetic Amylase (CL00037744)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTMLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 37 - protein, 432 aa, Artificial Sequence
  Synthetic Amylase (CL00037752)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVRAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 38 - protein, 432 aa, Artificial Sequence
  Synthetic Amylase (CL00037766)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTFLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 39 - protein, 432 aa, Artificial Sequence
  Synthetic Amylase (CL00037822)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTHLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 40 - protein, 432 aa, Artificial Sequence
  Synthetic Amylase (CL00038189)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTPLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 41 - protein, 432 aa, Artificial Sequence
  Synthetic Amylase (CL00038223)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTLLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 42 - protein, 432 aa, Artificial Sequence
  Synthetic Amylase (CL00038924)
LSPEEGGVMMQAFYWDVPEGGIWYDTIRAKIPDWAAAGITSIWLPPPSKGMSGFYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 43 - protein, 432 aa, Artificial Sequence
  Synthetic Amylase (CL00039053)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 44 - protein, 432 aa, Artificial Sequence
  Synthetic Amylase (CL00039248)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKTRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 45 - protein, 432 aa, Artificial Sequence
  Synthetic Amylase (CL00039301)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVHVPKFAGSTIHEYTGNLGGWVDKWVDSNGWVYLEAPPHDPANGYYGYSVWSYAGIG

SEQ ID NO: 46 - protein, 432 aa, Artificial Sequence
  Synthetic Amylase (CL00039390)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 47 - protein, 432 aa, Artificial Sequence
  Synthetic Amylase (CL00039414)
LSPEEGGVMMQAFYWDVPEGGIWYDTIRAKIPDWAAAGITSIWLPPPSKGMSGSYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 48 - protein, 432 aa, Artificial Sequence
  Synthetic Amylase (CL00044971)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNNGEWVDKWVDSNGWVYLEAPPHDPANGYYGYSVWSYAGIG

SEQ ID NO: 49 - protein, 432 aa, Artificial Sequence
  Synthetic Amylase (CL00044986)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNKGGWVDKWVDSNGWVYLEAPPHDPANGYYGYSVWSYAGIG

SEQ ID NO: 50 - protein, 432 aa, Artificial Sequence
  Synthetic Amylase (CL00045052)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGKRGGWVDKWVDSNGWVYLEAPPHDPANGYYGYSVWSYAGIG

SEQ ID NO: 51 - protein, 432 aa, Artificial Sequence
  Synthetic Amylase (CL00045079)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNQGGWVDKWVDSNGWVYLEAPPHDPANGYYGYSVWSYAGIG

SEQ ID NO: 52 - protein, 432 aa, Artificial Sequence
  Synthetic Amylase (CL00045095)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWSGRWVYVPKFAGSTIHEYTGNLGGWVDKWVDSNGWVYLEAPPHDPANGYYGYSVWSYAGIG

SEQ ID NO: 53 - protein, 432 aa, Artificial Sequence
  Synthetic Amylase (CL00045235)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWPGRWVYVPKFAGSTIHEYTGNLGGWVDKWVDSNGWVYLEAPPHDPANGYYGYSVWSYAGIG

SEQ ID NO: 54 - protein, 432 aa, Artificial Sequence
  Synthetic Amylase (CL00045254)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNPGGWVDKWVDSNGWVYLEAPPHDPANGYYGYSVWSYAGIG

SEQ ID NO: 55 - protein, 432 aa, Artificial Sequence
  Synthetic Amylase (CL00045306)
LSPEEGGVMMQAFYWDVPEGGIWYDTIRAKIPDWVAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 56 - protein, 432 aa, Artificial Sequence
  Synthetic Amylase (CL00045321)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNSGGWVDKWVDSNGWVYLEAPPHDPANGYYGYSVWSYAGIG

SEQ ID NO: 57 - protein, 432 aa, Artificial Sequence
  Synthetic Amylase (CL00045326)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNAGGWVDKWVDSNGWVYLEAPPHDPANGYYGYSVWSYAGIG

SEQ ID NO: 58 - protein, 432 aa, Artificial Sequence
  Synthetic Amylase (CL00045373)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNEGGWVDKWVDSNGWVYLEAPPHDPANGYYGYSVWSYAGIG

SEQ ID NO: 59 - protein, 432 aa, Artificial Sequence
  Synthetic Amylase (CL00045482)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGTTIHEYTGNLGGWVDKWVDSNGWVYLEAPPHDPANGYYGYSVWSYAGIG

SEQ ID NO: 60 - protein, 432 aa, Artificial Sequence
  Synthetic Amylase (CL00045491)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNRGGWVDKWVDSNGWVYLEAPPHDPANGYYGYSVWSYAGIG

SEQ ID NO: 61 - protein, 432 aa, Artificial Sequence
  Synthetic Amylase (CL00045496)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSIGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 62 - protein, 432 aa, Artificial Sequence
  Synthetic Amylase (CL00045673)
LSPEEGGVMMQAFYWDVPEGGIWYDTIRAKIPDWAAAGITSIWLPPPSKGMSGGYSMGYDPYDYFDLGEYYQMGSVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 63 - protein, 432 aa, Artificial Sequence
  Synthetic Amylase (CL00045765)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLMAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 64 - protein, 432 aa, Artificial Sequence
  Synthetic Amylase (CL00046070)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYCPKFAGSTIHEYTGNLGGWVDKWVDSNGWVYLEAPPHDPANGYYGYSVWSYAGIG

SEQ ID NO: 65 - protein, 432 aa, Artificial Sequence
  Synthetic Amylase (CL00046087)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAWYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 66 - protein, 432 aa, Artificial Sequence
  Synthetic Amylase (CL00046208)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLSAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 67 - protein, 432 aa, Artificial Sequence
  Synthetic Amylase (CL00046591)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFTRNGYGSKPGLITYINLGSGWAGRWVYVPKFAGSTIHEYTGNLGGWVDKWVDSNGWVYLEAPPHDPANGYYGYSVWSYAGIG

SEQ ID NO: 68 - protein, 432 aa, Artificial Sequence
  Synthetic Amylase (CL00046878)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWKRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 69 - protein, 432 aa, Artificial Sequence
  Synthetic Amylase (CL00046932)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 70 - protein, 432 aa, Artificial Sequence
  Synthetic Amylase (CL00046960)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVQVPKFAGSTIHEYTGNLGGWVDKWVDSNGWVYLEAPPHDPANGYYGYSVWSYAGIG

SEQ ID NO: 71 - protein, 432 aa, Artificial Sequence
  Synthetic Amylase (CL00046965)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 72 - protein, 432 aa, Artificial Sequence
  Synthetic Amylase (CL00047043)
LSPEEGGVMMQAFYWDVTEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 73 - protein, 432 aa, Artificial Sequence
  Synthetic Amylase (CL00047052)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 74 - protein, 432 aa, Artificial Sequence
  Synthetic Amylase (CL00047056)
LSPEEGGVMMQAFYWDVTEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTKLIWIHNNLAGGTTEIVYYDSDELIFVRNGYGSKPGLITYINLGSGWAGRWVQVPKFAGSTIHEYTGNLGGWVDKWVDSNGWVYLEAPPHDPANGYYGYSVWSYAGIG

SEQ ID NO: 75 - protein, 432 aa, Artificial Sequence
  Synthetic Amylase (CL00047106)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 76 - protein, 432 aa, Artificial Sequence
  Synthetic Amylase (CL00047134)
LSPEEGGVMMQAFYWDVTEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKTRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 77 - protein, 432 aa, Artificial Sequence
  Synthetic Amylase (CL00047179)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 78 - protein, 432 aa, Artificial Sequence
  Synthetic Amylase (CL00047183)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTHLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 79 - protein, 432 aa, Artificial Sequence
  Synthetic Amylase (CL00047186)
LSPEEGGVMMQAFYWDVTEGGIWYDTIRAKIPDWAAAGITSIWLPPPSKGMSGFYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKTRLTRLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 80 - protein, 432 aa, Artificial Sequence
  Synthetic Amylase (CL00047217)
LSPEEGGVMMQAFYWDVTEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 81 - protein, 432 aa, Artificial Sequence
  Synthetic Amylase (CL00047252)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVHVPKFAGSTIHEYTGNLGGWVDKWVDSNGWVYLEAPPHDPANGYYGYSVWSYAGIG

SEQ ID NO: 82 - protein, 432 aa, Artificial Sequence
  Synthetic Amylase (CL00047281)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 83 - protein, 432 aa, Artificial Sequence
  Synthetic Amylase (CL00047285)
LSPEEGGVMMQAFYWDVPEGGIWYDTIRAKIPDWAAAGITSIWLPPPSKGMSGFYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 84 - protein, 432 aa, Artificial Sequence
  Synthetic Amylase (CL00047289)
LSPEEGGVMMQAFYWDVPEGGIWYDTIRAKIPDWAAAGITSIWLPPPSKGMSGFYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWNSSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKTRLTLLIWIHNNLAGGTTEIVYYDSDELIFVRNGYGSKPGLITYINLGSGWAGRWVCVPKFAGSTIHEYTGNLGGWVDKWVDSNGWVYLEAPPHDPANGYYGYSVWSYAGIG

SEQ ID NO: 85 - protein, 432 aa, Artificial Sequence
  Synthetic Amylase (CL00047307)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 86 - protein, 432 aa, Artificial Sequence
  Synthetic Amylase (CL00047348)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVRAIQNGQVLVAVDPFDAVTFVANHDTDIIWNKYPAYAFILTYEGQPTIFYRDYEEWLNKTRLTRLIWIHNNLAGGTTEIVYYDSDELIFVRNGYGSKPGLITYINLGSGWAGRWVHVPKFAGSTIHEYTGNLGGWVDKWVDSNGWVYLEAPPHDPANGYYGYSVWSYAGIG

SEQ ID NO: 87 - protein, 432 aa, Artificial Sequence
  Synthetic Amylase (CL00047356)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTLLIWIHNNLAGGTTEIVYYDSDELIFVRNGYGSKPGLITYINLGSGWAGRWVHVPKFAGSTIHEYTGNLGGWVDKWVDSNGWVYLEAPPHDPANGYYGYSVWSYAGIG

SEQ ID NO: 88 - protein, 432 aa, Artificial Sequence
  Synthetic Amylase (CL00047406)
LSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVRAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 89 - protein, 435 aa, Artificial Sequence
  Synthetic Amylase (CL00050734)
AKYLELEEGGVIMQAFYWDVPGGGIWWDHIRSKIPEWYEAGISAIWLPPPSKGMSGGYSMGYDPYDLFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 90 - protein, 435 aa, Artificial Sequence
  Synthetic Amylase (CL00051180)
AKYLELEEGGVIMQAFYWDVPGGGIWWDHIRSKIPEWYEAGISAIWLPPPSKGMSGGYSMGYDPYDYFDLGEYYQKGTVETRLGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 91 - protein, 435 aa, Artificial Sequence
  Synthetic Amylase (CL00052897)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGDTVVSRDPFKAVTFVANHDTDIIWNKYPAYAFILTYEGQPVIFYRDYEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 92 - protein, 435 aa, Artificial Sequence
  Synthetic Amylase (CL00052900)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVKRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 93 - protein, 435 aa, Artificial Sequence
  Synthetic Amylase (CL00052961)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 94 - protein, 435 aa, Artificial Sequence
  Synthetic Amylase (CL00053009)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGDTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 95 - protein, 435 aa, Artificial Sequence
  Synthetic Amylase (CL00053023)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTHEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 96 - protein, 435 aa, Artificial Sequence
  Synthetic Amylase (CL00053036)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 97 - protein, 435 aa, Artificial Sequence
  Synthetic Amylase (CL00053038)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTHEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 98 - protein, 435 aa, Artificial Sequence
  Synthetic Amylase (CL00053062)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDEYIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 99 - protein, 435 aa, Artificial Sequence
  Synthetic Amylase (CL00053076)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTHEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 100 - protein, 435 aa, Artificial Sequence
  Synthetic Amylase (CL00053098)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 101 - protein, 435 aa, Artificial Sequence
  Synthetic Amylase (CL00053179)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVKRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 102 - protein, 435 aa, Artificial Sequence
  Synthetic Amylase (CL00053182)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 103 - protein, 435 aa, Artificial Sequence
  Synthetic Amylase (CL00053295)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTHEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 104 - protein, 435 aa, Artificial Sequence
  Synthetic Amylase (CL00053353)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKFTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVKRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 105 - protein, 435 aa, Artificial Sequence
  Synthetic Amylase (CL00053441)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDYEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 106 - protein, 435 aa, Artificial Sequence
  Synthetic Amylase (CL00053513)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADIVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 107 - protein, 435 aa, Artificial Sequence
  Synthetic Amylase (CL00053515)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPNFAGACIHEYTGNLGGWVDKRVDSSGWVYLEAPPHDPANGYYGYSVWSYCGVG

SEQ ID NO: 108 - protein, 435 aa, Artificial Sequence
  Synthetic Amylase (CL00053955)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRSGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTILYYDNDELIFVRNGDSRRPGLITYINLSPNWVGRWVYVPKWAGACIHEYTGNLGGWVDKRVDSSGWVYLEAPPHDPANGYYGYSVWSYCGVG

SEQ ID NO: 109 - protein, 435 aa, Artificial Sequence
  Synthetic Amylase (CL00054030)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFQAVTFVANHDTDIIWNKYPAYAFILTYEGQPVIFYRDFEEWLNKDKLINLIWIHDHLAGGSTTILYYDNDELIFVRNGDSRRPGLITYINLSPNWVGRWVYVPKFAGACIHEYTGNSGGWVDKRVDSSGWVYLEAPPHDPANGYYGYSVWSYCGVG

SEQ ID NO: 110 - protein, 435 aa, Artificial Sequence
  Synthetic Amylase (CL00054048)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQNVVSRDPFKAVTFVANHDTDIIWNKYPAYAFILTYEGQPVIFYRDFEEWLNKDKLINLIWIHDHLAGGSTTILYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 111 - protein, 435 aa, Artificial Sequence
  Synthetic Amylase (CL00054092)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRSGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 112 - protein, 435 aa, Artificial Sequence
  Synthetic Amylase (CL00054095)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLADGSTTIVYYDNDELIFVRNGDSRRPGLITYINLSPNWVGRWVYVPKWAGACIHEYTGNLGGWVDKRVDSSGWVYLEAPPHDPANGYYGYSVWSYCGVG

SEQ ID NO: 113 - protein, 435 aa, Artificial Sequence
  Synthetic Amylase (CL00054107)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRSGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTILYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 114 - protein, 435 aa, Artificial Sequence
  Synthetic Amylase (CL00054111)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKWAGACIHEYTGNSGGWVDKRVDSSGWVYLEAPPHDPANGYYGYSVWSYCGVG

SEQ ID NO: 115 - protein, 435 aa, Artificial Sequence
  Synthetic Amylase (CL00054116)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNSGGWVDKRVDSSGWVYLEAPPHDPANGYYGYSVWSYCGVG

SEQ ID NO: 116 - protein, 435 aa, Artificial Sequence
  Synthetic Amylase (CL00054126)
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQMVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 117 - protein, 432 aa, Artificial Sequence
  Synthetic Amylase (CL00047034)
LSPEEGGVMMQAFYWDVPEGGIWYDTIRAKIPDWAAAGITSIWLPPPSKGMSGNYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHRKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTRLIWIHNNLAGGTTEIVYYDSDELIFVRNGYGSKPGLITYINLGSGWAGRWVHVPKFAGSTIHEYTGNLGGWVDKWVDSNGWVYLEAPPHDPANGYYGYSVWSYAGIG

SEQ ID NO: 118 - protein, 460 aa, Artificial Sequence
  Amylase (Pp.Amy Pre region and mature region)
MRTGLKKVLAIFGLLLIVLSFTAEQAIALSPEEGGVMMQAFYWDVPEGGIWYDTIRAKIPDWAAAGITSIWLPPPSKGMSGGYSMGYDPYDYFDLGEYYQMGTVETRFGSKQELIDLINTAHSYGLEVYADIVINHRAGGDLEWNPFVNDYTWTDFSKVASGKYTANYLDFHPNELHASDAGAFGGYPDICHDKSWDQYWLWASSESYAAYLKSVGFDGWRFDYVKGYDPWVVKDWLSWWGGYAVGEYWDTNVNLVLDWIRGSGANAFDFALYYKMDEAFDNTNIPALVSAIQNGQVLVAVDPFDAVTFVANHDTDIIWNKYPAYAFILTYEGQPTIFYRDYEEWLNKDRLTNLIWIHNNLAGGTTEIVYYDSDELIFVRNGYGSKPGLITYINLGSGWAGRWVYVPKFAGSTIHEYTGNLGGWVDKWVDSNGWVYLEAPPHDPANGYYGYSVWSYAGIG

SEQ ID NO: 119 - protein, 460 aa, Artificial Sequence
  Amylase (Pf.Amy Pre region and mature region)
MNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 120 - DNA, 1302 bp, Artificial Sequence
  Amylase (CL00026174 Pp.Amy G1P)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 121 - DNA, 1302 bp, Artificial Sequence
  Synthetic Amylase (CL00034838)
ctatccccagaagaaggcggagtaatgatgcaagcgttctactgggacgttccggcgggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 122 - DNA, 1302 bp, Artificial Sequence
  Synthetic Amylase (CL00034918)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagacgggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 123 - DNA, 1302 bp, Artificial Sequence
  Synthetic Amylase (CL00034919)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggatacatggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 124 - DNA, 1302 bp, Artificial Sequence
  Synthetic Amylase (CL00034933)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagtgtggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 125 - DNA, 1302 bp, Artificial Sequence
  Synthetic Amylase (CL00034936)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggggaatggttattatggctactccgtctggagctacgcggggattggctaatag

SEQ ID NO: 126 - DNA, 1302 bp, Artificial Sequence
  Synthetic Amylase (CL00034950)
ctatccccagaagaaggcggagtaatgatgcaagcgttctactgggacgttccggatggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 127 - DNA, 1302 bp, Artificial Sequence
  Synthetic Amylase (CL00035000 Pp.Amy G1V5)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggtacttatggctactccgtctggagctacgcggggattggctaatag

SEQ ID NO: 128 - DNA, 1302 bp, Artificial Sequence
  Synthetic Amylase (CL00035021)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacctatttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 129 - DNA, 1302 bp, Artificial Sequence
  Synthetic Amylase (CL00035092)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggtttgtatggctactccgtctggagctacgcggggattggctaatag

SEQ ID NO: 130 - DNA, 1302 bp, Artificial Sequence
  Synthetic Amylase (CL00035110)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactggcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 131 - DNA, 1302 bp, Artificial Sequence
  Synthetic Amylase (CL00035119)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccgttttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 132 - DNA, 1302 bp, Artificial Sequence
  Synthetic Amylase (CL00035153)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcaatggatgggtcgataagtgggtcgattcaaacggatgggtatatcttgaggcgccacctcacgatccggccaatggttattatggctactccgtctggagctacgcggggattggctaatag

SEQ ID NO: 133 - DNA, 1302 bp, Artificial Sequence
  Synthetic Amylase (CL00035195)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcacgggatgggtcgataagtgggtcgattcaaacggatgggtatatcttgaggcgccacctcacgatccggccaatggttattatggctactccgtctggagctacgcggggattggctaatag

SEQ ID NO: 134 - DNA, 1302 bp, Artificial Sequence
  Synthetic Amylase (CL00035200)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacctttttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 135 - DNA, 1302 bp, Artificial Sequence
  Synthetic Amylase (CL00035271)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctcgggttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 136 - DNA, 1302 bp, Artificial Sequence
  Synthetic Amylase (CL00035301)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccacgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 137 - DNA, 1302 bp, Artificial Sequence
  Synthetic Amylase (CL00035364)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcccgggatgggtcgataagtgggtcgattcaaacggatgggtatatcttgaggcgccacctcacgatccggccaatggttattatggctactccgtctggagctacgcggggattggctaatag

SEQ ID NO: 138 - DNA, 1302 bp, Artificial Sequence
  Synthetic Amylase (CL00035374 Pp.Amy G1V2)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 139 - DNA, 1302 bp, Artificial Sequence
  Synthetic Amylase (CL00035764 Pp.Amy G1V4)
ctatccccagaagaaggcggagtaatgatgcaagcgttctactgggacgttccggagggtggagcttggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacgacaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 140 - DNA, 1302 bp, Artificial Sequence
  Synthetic Amylase (CL00035771 Pp.Amy G1V3)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccacaataagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 141 - DNA, 1302 bp, Artificial Sequence
  Synthetic Amylase (CL00036023 Pp.Amy G1V1) (G2P)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 142 - DNA, 1302 bp, Artificial Sequence
  Synthetic Amylase (CL00037324)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccgcgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 143 - DNA, 1302 bp, Artificial Sequence
  Synthetic Amylase (CL00037336)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccctgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 144 - DNA, 1302 bp, Artificial Sequence
  Synthetic Amylase (CL00037348)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccgggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 145 - DNA, 1302 bp, Artificial Sequence
  Synthetic Amylase (CL00037355)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacctgtttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 146 - DNA, 1302 bp, Artificial Sequence
  Synthetic Amylase (CL00037383)
ctatccccagaagaaggcggagtaatgatgcaagcgttctactgggacgttacggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaatttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 147 - DNA, 1302 bp, Artificial Sequence
  Synthetic Amylase (CL00037385)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaagttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 148 - DNA, 1302 bp, Artificial Sequence
  Synthetic Amylase (CL00037406)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaatagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 149 - DNA, 1302 bp, Artificial Sequence
  Synthetic Amylase (CL00037470)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccagtttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 150 - DNA, 1302 bp, Artificial Sequence
  Synthetic Amylase (CL00037593)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccacgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 151 - DNA, 1302 bp, Artificial Sequence
  Synthetic Amylase (CL00037702 Pp.Amy G2V1) (G3P)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 152 - DNA, 1302 bp, Artificial Sequence
  Synthetic Amylase (CL00037744)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccatgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 153 - DNA, 1302 bp, Artificial Sequence
  Synthetic Amylase (CL00037752)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtccgggccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 154 - DNA, 1302 bp, Artificial Sequence
  Synthetic Amylase (CL00037766)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacctttttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 155 - DNA, 1302 bp, Artificial Sequence
  Synthetic Amylase (CL00037822)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccatttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 156 - DNA, 1302 bp, Artificial Sequence
  Synthetic Amylase (CL00038189)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccctttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 157 - DNA, 1302 bp, Artificial Sequence
  Synthetic Amylase (CL00038223)
ctatccccagaagaaggcggagtaatgatgcaagcgttctactgggacgttacggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccttgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 158 - DNA, 1302 bp, Artificial Sequence
  Synthetic Amylase (CL00038924)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggattttattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 159 - DNA, 1302 bp, Artificial Sequence
  Synthetic Amylase (CL00039053)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaattattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 160 - DNA, 1302 bp, Artificial Sequence
  Synthetic Amylase (CL00039248)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaagacgaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 161 - DNA, 1302 bp, Artificial Sequence
  Synthetic Amylase (CL00039301)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 162 - DNA, 1302 bp, Artificial Sequence
  Synthetic Amylase (CL00039390)
ctatccccagaagaaggcggagtaatgatgcaagcgttctactgggacgttacggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 163 - DNA, 1302 bp, Artificial Sequence
  Synthetic Amylase (CL00039414)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaagttattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaacttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 164 - DNA, 1302 bp, Artificial Sequence
  Synthetic Amylase (CL00044971)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacaatggggaatgggtcgataagtgggtcgattcaaacggatgggtatatcttgaggcgccacctcacgatccggccaatggttattatggctactccgtctggagctacgcggggattggctaatag

SEQ ID NO: 165 - DNA, 1302 bp, Artificial Sequence
  Synthetic Amylase (CL00044986)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacaaggggggatgggtcgataagtgggtcgattcaaacggatgggtatatcttgaggcgccacctcacgatccggccaatggttattatggctactccgtctggagctacgcggggattggctaatag

SEQ ID NO: 166 - DNA, 1302 bp, Artificial Sequence
  Synthetic Amylase (CL00045052)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaagcgagggggatgggtcgataagtgggtcgattcaaacggatgggtatatcttgaggcgccacctcacgatccggccaatggttattatggctactccgtctggagctacgcggggattggctaatag

SEQ ID NO: 167 - DNA, 1302 bp, Artificial Sequence
  Synthetic Amylase (CL00045079)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaaccaggggggatgggtcgataagtgggtcgattcaaacggatgggtatatcttgaggcgccacctcacgatccggccaatggttattatggctactccgtctggagctacgcggggattggctaatag

SEQ ID NO: 168 - DNA, 1302 bp, Artificial Sequence
  Synthetic Amylase (CL00045095)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctggtctggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 169 - DNA, 1302 bp, Artificial Sequence
  Synthetic Amylase (CL00045235)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctggcctggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 170 - DNA, 1302 bp, Artificial Sequence
  Synthetic Amylase (CL00045254)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaaccctgggggatgggtcgataagtgggtcgattcaaacggatgggtatatcttgaggcgccacctcacgatccggccaatggttattatggctactccgtctggagctacgcggggattggctaatag

SEQ ID NO: 171 - DNA, 1302 bp, Artificial Sequence
  Synthetic Amylase (CL00045306)
ctatccccagaagaaggcggagtaatgatgcaagcgttctactgggacgttccggagggtggaatatggtacgacacaataagggccaaaattcccgattgggttgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 172 - DNA, 1302 bp, Artificial Sequence
  Synthetic Amylase (CL00045321)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacagtgggggatgggtcgataagtgggtcgattcaaacggatgggtatatcttgaggcgccacctcacgatccggccaatggttattatggctactccgtctggagctacgcggggattggctaatag

SEQ ID NO: 173 - DNA, 1302 bp, Artificial Sequence
  Synthetic Amylase (CL00045326)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacgctgggggatgggtcgataagtgggtcgattcaaacggatgggtatatcttgaggcgccacctcacgatccggccaatggttattatggctactccgtctggagctacgcggggattggctaatag

SEQ ID NO: 174 - DNA, 1302 bp, Artificial Sequence
  Synthetic Amylase (CL00045373)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacgaggggggatgggtcgataagtgggtcgattcaaacggatgggtatatcttgaggcgccacctcacgatccggccaatggttattatggctactccgtctggagctacgcggggattggctaatag

SEQ ID NO: 175 - DNA, 1302 bp, Artificial Sequence
  Synthetic Amylase (CL00045482)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggtactacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 176 - DNA, 1302 bp, Artificial Sequence
  Synthetic Amylase (CL00045491)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaaccgtgggggatgggtcgataagtgggtcgattcaaacggatgggtatatcttgaggcgccacctcacgatccggccaatggttattatggctactccgtctggagctacgcggggattggctaatag

SEQ ID NO: 177 - DNA, 1302 bp, Artificial Sequence
  Synthetic Amylase (CL00045496)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcattggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 178 - DNA, 1302 bp, Artificial Sequence
  Synthetic Amylase (CL00045673)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggatctgtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 179 - DNA, 1302 bp, Artificial Sequence
  Synthetic Amylase (CL00045765)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttaatggcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 180 - DNA, 1302 bp, Artificial Sequence
  Synthetic Amylase (CL00046070)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctattgtccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 181 - DNA, 1302 bp, Artificial Sequence
  Synthetic Amylase (CL00046087)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcgtggtatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 182 - DNA, 1302 bp, Artificial Sequence
  Synthetic Amylase (CL00046208)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttatctgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 183 - DNA, 1302 bp, Artificial Sequence
  Synthetic Amylase (CL00046591)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttactaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 184 - DNA, 1302 bp, Artificial Sequence
  Synthetic Amylase (CL00046878)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggaagagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 185 - DNA, 1302 bp, Artificial Sequence
  Synthetic Amylase (CL00046932)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 186 - DNA, 1302 bp, Artificial Sequence
  Synthetic Amylase (CL00046960)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccaagttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 187 - DNA, 1302 bp, Artificial Sequence
  Synthetic Amylase (CL00046965)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 188 - DNA, 1302 bp, Artificial Sequence
  Synthetic Amylase (CL00047034)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 189 - DNA, 1302 bp, Artificial Sequence
  Synthetic Amylase (CL00047043)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 190 - DNA, 1302 bp, Artificial Sequence
  Synthetic Amylase (CL00047052)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 191 - DNA, 1302 bp, Artificial Sequence
  Synthetic Amylase (CL00047056)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccaagttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccaagttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 192 - DNA, 1302 bp, Artificial Sequence
  Synthetic Amylase (CL00047106)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 193 - DNA, 1302 bp, Artificial Sequence
  Synthetic Amylase (CL00047134)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaagactaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 194 - DNA, 1302 bp, Artificial Sequence
  Synthetic Amylase (CL00047179)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 195 - DNA, 1302 bp, Artificial Sequence
  Synthetic Amylase (CL00047183)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccatttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 196 - DNA, 1302 bp, Artificial Sequence
  Synthetic Amylase (CL00047186)
ctatccccagaagaaggcggagtaatgatgcaagcgttctactgggacgttactgagggtggaatatggtacgacacaataagggccaaaattcccgattgggctgctgctggaataacttccatctggctcccgccgccatccaagggcatgagcggattctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaagactaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 197 - DNA, 1302 bp, Artificial Sequence
  Synthetic Amylase (CL00047217)
ctatccccagaagaaggcggagtaatgatgcaagcgttctactgggacgttactgagggcggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 198 - DNA, 1302 bp, Artificial Sequence
  Synthetic Amylase (CL00047252)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 199 - DNA, 1302 bp, Artificial Sequence
  Synthetic Amylase (CL00047281)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 200 - DNA, 1302 bp, Artificial Sequence
  Synthetic Amylase (CL00047285)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggattctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 201 - DNA, 1302 bp, Artificial Sequence
  Synthetic Amylase (CL00047289)
ctatccccagaagaaggcggagtaatgatgcaagcgttctactgggacgttccagagggtggaatatggtacgacacaataagggccaaaattcccgattgggctgctgctggaataacttccatctggctcccgccgccatccaagggcatgagcggattctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctggaacagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaagactaggctcaccttgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctgtgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 202 - DNA, 1302 bp, Artificial Sequence
  Synthetic Amylase (CL00047307)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 203 - DNA, 1302 bp, Artificial Sequence
  Synthetic Amylase (CL00047348)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtcagagccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaagactaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 204 - DNA, 1302 bp, Artificial Sequence
  Synthetic Amylase (CL00047356)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaaactattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtctccgccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcaccttgttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtccatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 205 - DNA, 1302 bp, Artificial Sequence
  Synthetic Amylase (CL00047406)
ctatccccagaagaaggcggagtaatgatgcaagcgttctactgggacgttccggagggtggaatatggtacgacacaataagggccaaaattcccgattgggctgctgctggaataacttccatctggctcccgccgccatccaagggcatgagcggaggctattcgatgggttatgatccctacgactactttgacctcggcgaatactatcagatgggaacggtagagactcgcttcggttcaaagcaagagttaatagacctcataaacactgcccactcctatgggcttgaggtctacgccgacatagtaataaaccaccgcgccggcggcgatttggagtggaacccctttgtgaacgactacacatggacggacttttctaaagttgcctcgggcaagtacaccgccaactacctcgacttccatcccaacgagcttcacgccagtgatgctggagctttcggcggctatccggatatatgccaccgtaagagctgggatcagtactggctctgggcgagcagtgagagctatgcggcatatcttaaaagcgtcggcttcgatgggtggcgcttcgattacgtcaagggctatgacccgtgggtcgtgaaggactggctcagctggtggggcggctatgcagtcggagagtactgggacaccaacgtaaacctcgtcttggactggataagaggaagcggggccaatgcttttgacttcgcgctctactacaagatggatgaggcctttgacaacactaacatccccgcactcgtcagagccatacagaacggacaggttttagttgcggttgatcccttcgatgcggtaacctttgtggcaaatcacgacacggacataatatggaacaagtacccagcatacgcattcattctcacctatgagggacaaccaacgatattttaccgggactacgaagagtggctcaacaaggacaggctcacccggttaatctggatacacaacaacctggcgggcggaaccacggaaatagtttactacgacagcgatgagcttatctttgtgaggaatggctatggaagcaagcccggactgataacatacatcaatctcggaagcggctgggcaggaaggtgggtctatgttccgaagttcgccggttcaacgatacatgaatacaccggcaacctcgggggatgggtcgataagtgggtcgattcaaacggatgggtatatcttgaggcgccacctcacgatccggccaatggttattatggctactccgtctggagctacgcggggattggctaatag

SEQ ID NO: 206 - DNA, 1311 bp, Artificial Sequence
  Amylase (CL00049011 Pf.Amy G1P)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 207 - DNA, 1311 bp, Artificial Sequence
  Synthetic Amylase (CL00050734)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgatctgttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 208 - DNA, 1311 bp, Artificial Sequence
  Synthetic Amylase (CL00050960)
gctaagtacttggaattggaagagggtggtgttattatgcaagctttttattggaaggttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 209 - DNA, 1311 bp, Artificial Sequence
  Synthetic Amylase (CL00051180)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagactgggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 210 - DNA, 1311 bp, Artificial Sequence
  Synthetic Amylase (CL00052897)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtgatactgttgtttccagagatccattcaaggctgttactttcgttgctaaccacgatactgatatcatctggaacaaatacccagcttatgctttcattttgacttacgaaggtcaaccagttattttctacagagattatgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 211 - DNA, 1311 bp, Artificial Sequence
  Synthetic Amylase (CL00052900)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgttaagagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 212 - DNA, 1311 bp, Artificial Sequence
  Synthetic Amylase (CL00052961)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 213 - DNA, 1311 bp, Artificial Sequence
  Synthetic Amylase (CL00052982 Pf.Amy G1V1)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgactcacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 214 - DNA, 1311 bp, Artificial Sequence
  Synthetic Amylase (CL00053009)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtgatactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 215 - DNA, 1311 bp, Artificial Sequence
  Synthetic Amylase (CL00053023)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgactcacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 216 - DNA, 1311 bp, Artificial Sequence
  Synthetic Amylase (CL00053036)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 217 - DNA, 1311 bp, Artificial Sequence
  Synthetic Amylase (CL00053038)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgactcacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 218 - DNA, 1311 bp, Artificial Sequence
  Synthetic Amylase (CL00053062)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagtatatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 219 - DNA, 1311 bp, Artificial Sequence
  Synthetic Amylase (CL00053076)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgactcacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 220 - DNA, 1311 bp, Artificial Sequence
  Synthetic Amylase (CL00053098)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 221 - DNA, 1311 bp, Artificial Sequence
  Synthetic Amylase (CL00053179)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgttaagagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 222 - DNA, 1311 bp, Artificial Sequence
  Synthetic Amylase (CL00053182)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 223 - DNA, 1311 bp, Artificial Sequence
  Synthetic Amylase (CL00053295)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgactcacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 224 - DNA, 1311 bp, Artificial Sequence
  Synthetic Amylase (CL00053353)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaattcactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgttaagagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 225 - DNA, 1311 bp, Artificial Sequence
  Synthetic Amylase (CL00053441)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagattatgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 226 - DNA, 1311 bp, Artificial Sequence
  Synthetic Amylase (CL00053513)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatattgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 227 - DNA, 1311 bp, Artificial Sequence
  Synthetic Amylase (CL00053515)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaatttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 228 - DNA, 1311 bp, Artificial Sequence
  Synthetic Amylase (CL00053955)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagatctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcttgtactacgataacgatgagttgatttttgttagaaacggagattccagaagacctggtttgatcacttacatcaatttgtctccaaactgggttggtagatgggtttacgttcctaagtgggctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 229 - DNA, 1311 bp, Artificial Sequence
  Synthetic Amylase (CL00054030)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattccaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcttgtactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaattctggtggttgggttgataaaagagttgattcttctggttgggtttatttggaggctcctccacacgatcctgctaacggttactatggttactctgtttggtcttattgtggtgttggttaataa

SEQ ID NO: 230 - DNA, 1311 bp, Artificial Sequence
  Synthetic Amylase (CL00054048)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaaatgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcttgtactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 231 - DNA, 1311 bp, Artificial Sequence
  Synthetic Amylase (CL00054092)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagatctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 232 - DNA, 1311 bp, Artificial Sequence
  Synthetic Amylase (CL00054095)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctgatggttctactactatcgtttactacgataacgatgagttgatttttgttagaaacggagattccagaagacctggtttgatcacttacatcaatttgtctccaaactgggttggtagatgggtttacgttcctaagtgggctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 233 - DNA, 1311 bp, Artificial Sequence
  Synthetic Amylase (CL00054107)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagatctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcttgtactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

SEQ ID NO: 234 - DNA, 1311 bp, Artificial Sequence
  Synthetic Amylase (CL00054111)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagtgggctggtgcttgtatccatgaatacactggtaattctggtggttgggttgataaaagagttgattcttctggttgggtttatttggaggctcctccacacgatcctgctaacggttactatggttactctgtttggtcttattgtggtgttggttaataa

SEQ ID NO: 235 - DNA, 1311 bp, Artificial Sequence
  Synthetic Amylase (CL00054116)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaactgttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaattctggtggttgggttgataaaagagttgattcttctggttgggtttatttggaggctcctccacacgatcctgctaacggttactatggttactctgtttggtcttattgtggtgttggttaataa

SEQ ID NO: 236 - DNA, 1311 bp, Artificial Sequence
  Synthetic Amylase (CL00054126)
gctaagtacttggaattggaagagggtggtgttattatgcaagctttttattgggatgttccaggtggtggtatttggtgggatcatattagatctaagattcctgaatggtacgaggctggtatttctgctatttggttgccacctccatctaaaggaatgtctggtggttactctatgggttatgatccatacgattacttcgatttgggtgaatactaccaaaagggtactgttgagactagattcggttctaaagaagagttggttagattgattcaaactgctcatgcttacggtattaaggttattgctgatgttgttattaatcacagagctggtggagatttggaatggaacccttttgttggagattatacttggactgatttctctaaggttgcttctggtaaatacactgctaactatttggatttccatccaaacgaattgcactgttgtgatgagggtacttttggtggtttccctgatatttgtcatcacaaggaatgggatcaatactggttgtggaaatctaatgagtcttacgctgcttatttgagatctattggttttgatggttggagattcgattacgttaaaggttatggtgcttgggttgttagagattggttgaattggtggggtggttgggctgttggtgaatactgggatactaacgttgatgctttgttgtcttgggcttatgagtctggtgctaaggttttcgatttcccattgtactacaagatggatgaagctttcgataacaacaacattcctgctttggtttatgctttgcaaaacggtcaaatggttgtttccagagatccattcaaggctgttactttcgttgctaaccacgatactgatatcatctggaacaaatacccagcttatgctttcattttgacttacgaaggtcaaccagttattttctacagagatttcgaagagtggttgaataaggataagttgattaacttgatctggattcatgatcacttggctggtggttctactactatcgtttactacgataacgatgagttgatttttgttagaaacggagattccagaagacctggtttgatcacttacatcaatttgtctccaaactgggttggtagatgggtttacgttcctaagttcgctggtgcttgtatccatgaatacactggtaatttgggtggttgggttgataaaagagttgattcttctggttgggtttatttggaggctcctccacacgatcctgctaacggttactatggttactctgtttggtcttattgtggtgttggttaataa

What is claimed is:

1. A composition comprising a variant amylase enzyme having amylase activity, wherein said variant amylase enzyme has at least one amino acid substitution that corresponds to an amino acid substitution in SEQ ID NO: 4 selected form the group consisting of D19K, Y67L, F83L, V107I, A113S, Y139F, Q271D, T272N, T272M, S275K, K280Q, Y306H, F317Y, G338D, V344L, L351Y, K383N, F384W and L396S, and wherein said variant amylase enzyme has at least 95% sequence identity to the polypeptide of SEQ ID NO:4.

2. The composition according to claim 1, wherein said variant amylase enzyme has at least 98% sequence identity to the polypeptide of SEQ ID NO:4.

3. The composition according to claim 1, wherein said variant amylase enzyme has one, two, three, four, five, six or seven of said amino acid substitutions.

4. The composition according to claim 1, wherein said at least one amino acid substitution is selected from the group consisting of: Y67L, D19K, F83L, V107I/Q271D/F317Y/K383N, S275K/K383N, Y139F/K383N, V107I/Y306H/K383N, V107I/Y139F/Q271D/K383N, V107I/Y306H, V107I, Y306H/K383N, L351Y/K383N, Y306H, V107I/Y139F, S275K, Y139F, Y139F/Y306H, Y139F/S275K, F317Y, V107I/K383N, K383N, A113S/V344L/F384W, K280Q/V344L/L396S, T272N/V344L, A113S, G338D/F384W, A113S/V344L, F384W/L396S, L396S and T272M.

5. The composition according to claim 1, wherein said at least one amino acid substitution is D19K or V107I/Y306H/K383N.

6. The composition according to claim 1, wherein said amino acid substitution is D19K, and wherein said variant amylase enzyme has at least 95% sequence identity to the polypeptide of SEQ ID NO: 10.

7. The composition according to claim 1, wherein said variant amylase enzyme has SEQ ID NO:10.

8. The composition according to claim 1, wherein said amino acid substitutions are V107I/Y306H/K383N, and wherein said variant amylase enzyme has at least 95% sequence identity to the polypeptide of SEQ ID NO:9.

9. The composition according to claim 1, wherein said variant amylase enzyme has SEQ ID NO:9.

10. A method of making a variant amylase enzyme, wherein said method comprises substituting one or more amino acids in the parent amylase enzyme of SEQ ID NO: 4 to obtain one or more amino acid substitutions selected from the group consisting of D19K, Y67L, F83L, V107I, A113S, Y139F, Q271D, T272N, T272M, S275K, K280Q, Y306H, F317Y, G338D, V344L, L351Y, K383N, F384W and L396S, wherein said variant amylase enzyme has amylase activity, and wherein said variant amylase enzyme has at least 95% sequence identity to the polypeptide of SEQ ID NO:4.

11. A method for hydrolysis of starch, wherein said method comprises contacting said starch with said variant amylase of claim 1.

\* \* \* \* \*